United States Patent 7,494,798 (BACILLUS LICHENIFORMIS CHROMOSOME) - sequence listing, part 4

SEQ ID NO: 4081 - DNA, 1359 bp, Bacillus licheniformis
atgttaaaactgtttaagccagcaccgccgattgagcggctgccggaagatcaaattgattcggaatataagaaattcagactgcaagtttttctcggcatcttcatcggttatgcggcatactatttaattcgcaaaaatttctcgcttgccatgccttatttgatcgaagagggcttttcaaagtcggcgctcggctttgccttgtccgctctatccatctcttacgggctgagcaagttcgtgatggccacgatatcggaccggagcaatccgaggatgttcctgcccgccggtttgatcctttccgctgtcatcagcctcttgatggggtttgttccttttttcacctcatcgatcgccattatgtttatcatgctgttcttaaacggctggttccagggcatgggatggccgccgtcagggcgtgtccttgtccactggttcagcgtcagcgaaaggggaaataaaaccgccatatggaatgtcgcccacaatgtcggcgggggactgatggcgccgattgccgttgccggcgtcgccatcttctcaggcataacgggatctgctacaggctatgaaggtgtgtttattttgccggccttggtcgccatcgccgttgccgtcatttcttactggctgatccgggatacgccgcagtctgtcggacttcctccaatcgaggaataccgcaacgattattcaagcaaatcgaagaaaacctttgaaaaggaattatcaacgaaagaaatccttttcaaacatgtattaaataataaatgggtgtgggcgatcgcacttgccaacattttcgtgtacttcgtccgctacggcgttctggattgggctccaacctatttaagcgaagaaaaaggctttgacatgagcaaatcaagcgtcgcttattttctgtatgaatgggcggggattccggggacattgctgtgcggctggatctctgacaaatggtttaaaggacgccgcggaccggcaggctttgtctttatggcaggtgttttgatcgcggtgcttgtgtactggttcaacccagccggcaatccgatgatcgacatggcatcattgatcgcgatcggattcctcatttacggtcccgtcatgctgatcggccttcaagcgcttgactttgttcctaaaaaagcggccggcacggctgcaggattgaccggtctgttcggttacctgggcggaaccttgacggcgaatgcgctgatgggtgttatcgtcgatgcatccggctggaatgcgggctttacgcttttaaccgcttcatgtgcaatcgcagcactcatatttgcgatgacttggaatgtgcggggacaggaagttgtgaagcattaa

SEQ ID NO: 4082 - DNA, 1881 bp, Bacillus licheniformis
atggctaagagagaattcaaagcagaatccaagcgattgctggacatcatgatcaactcgatttattcccaaaaggaagtctttttaagggagctgatatccaatgcgagcgatgccatcgataaaatctactacaaagcgctgacagatgattcactgacatttaacaaagacgattactacataaaaatctccgcagataaagaaaacagaacgctgaccattgcggacaccggaatcggcatgacgaaagaagagcttgaagagcatcttggaacgattgccaagagcggctcgcttgcgtttaaacaagaaaacgaattaaaagacgggcacgatattatcggccagttcggcgtcggtttctacgccgcttttatggttgcggacaccgtcaccgtcattacaaaagcccatggcagcgatgaagcgcatcaatgggaatcagccggagccgacggctatacaatcgaaccggctgcgaaagaatcagccggaaccgatgtcattctgaagctgaaagagaatacagacgatgaaaactatgatgaatacctggatgttcatcgcttaaaagcgatcatcaaaacatactctgatttcatccgctacccgatcaagatggatgtcgcggtcaacaagccgaaagaaggcgccgaaaatgaatttgaagaagtccaggaagaacagacggtcaacagcatggtgccgatttggagaaaaaacaaaagcgaactgaaagatgaagattatgaggcgttttataaggaaaagcattacggttttgacaagcctctcgcgcacatccatacaagcgtagacggcgcggtgagataccatgcgattttattcattcctgaaaatattccgttcaactactacacgaaggaattcgagaagggtctggaactgtattcgaacggtgtgctgatcatggaaaagtgtccggatctgctgcctgaccatttcagctttgtcaaaggaatggttgattcagaagatttatcgctcaacatttcgagggagatgctccagcatgacaggcagctgaagctgattgccaaaaacatcagcaaaaaaatcaagaatgagctgaagagcttgctgaaaaatgacagagaaaaatacgagtctttttatcaatcgtttggcagacagcttaaattcggggtatacaatgattttggagcccataaagatctgttgaaagacctgctgcttttctattcatcaaaagagaaaaagctggtcacccttgaggaatatgtgtccagaatgcctgaagatcaaaaatacatttattatgcatcaggcgactcgtatgaccgaatagaaaagcttcctcaaaccgagctggtttcggaaaaagggtatgaaatcctttatttcaccgaggatatcgatgagttcgccatcaaaatgctggcgaattatcaagagaaagaattcaagtcggtatcaagcggcgacctcggaatcgaaaacgatgacgagcaaaaccaatctgacggggatgacagccaatacaaagacctgtttgaagagatgaaaaagactctggatggaaaagtgaaaagcgtgagggcgtcaaaacggctgaagactcactccgtatgccttgccgctgacggagaagtcaccatcgagatggagaaaatcttaaacgcaatgcctgacaatcagcatgtaaaggctgataaagtattggaaatcaatacaaaccacgaagtcttcaaaacattgcagaatgcttttgacaacgacaaggataaattcaaactgtacaccggcctcctgtacaaccaggcgctgctgatagaaggcttgccaattgaagaccccgtcgaatttacgaacgatatatgcaaagtaatggcataa

SEQ ID NO: 4083 - DNA, 1536 bp, Bacillus licheniformis
atgagtattgttcatgtaacgaatttgacccatatatatggagaccgcatgatctttcaagacgccgggttccgcctgctgaaaggggaacatgccggtcttgtcggtgcaaacggagccggaaagtcgacattgctgcgcattttgacgggcagccttctgcccgatcatggaaacattgaatggcagccaaacattcgggtcggctttcttgaacagcatgccaagctgacggaaggcacaaccattcttcagtacatggagaaagcgtacggccggctgtttgaaatcgaaaaggaaatgaatgggcttgccgaaaaaatggccgatgccggagacaaccttgaagccgtcctgaaaagatacggagagcttcaggctgagctggaagcttcaggattttaccaaatcggaacgaaaattgaggatgccgcacaaggcctcggcttggcggaaatcgggcttgaccaggatgtcacggctttaagcggcgggcagcgtacaaagctgctgcttgccaaactgctgcttgaagagcctgatgtactgctgttggatgagccgaccaactatttggatgccgctcacattgagtggctgactggctacttgaaaaactatgagcacgcatttcttgtcatctctcatgacgaacgcttcttaaatgaaattacgacggttacattccatctggagcatcatgtgatcaaacgttattccggcaactatcaatatttcctgaaggagtatgcgcaaatcagggcacaggctgaagccgcatatgcaaaacagaacagggaaatcaaaaagttagaggcgtttatcgaccggaacagagtccgaaaggcgaaacaggccaaaagcagggagaaagcattacgcaaaatcaagcgaatcgaaaaaccgacagattcttatgtcccaagctttgcatttaaaacggggcgaaacccggcgatgactgtactcaaaacggaaaatcttgaggccggctacacagttccattatttaagcctctttccctgaccgtaagacggggcgataaaatcgcgattattggagaaaacggcgccggaaaatcgacgcttatcaaaacgctgctcggcgacctcaagcctctgagcggcatcgtcacagcaggacagcatttacaggcggcctatttcaggcaggaaagcccagcttctcatgatacaccgcttgaaaaattgcgggcgttctatcctgatctaccggaaaaagacatcaggcagacgctcgcggtatccggcttgacgccaaagcatatcagccagcccctttttacgctcagcggcggtgaacaggcaaaggtccggctggcggagctgatgctttcaaacagcaacctgcttgttcttgatgaaccgacaaaccatcttgacgcatcggcaaagcatgcgttaaagcaagcgctctgcgactataagggaacgattttgctcgtatcccatgaaccggctttttatgaagactgggtgactcatatctggcagattgaagcatggcgccgttaa

SEQ ID NO: 4084 - DNA, 813 bp, Bacillus licheniformis
atgtacaaactaatcgcgatagatatggatggaacattgttgaatgatcttcatgaagtaacagaggaagtacggaatgccctgcatgccgcgaaaaaacaaggcgtaaaaatcgttctctgcacgggccgtcccctcggcggtgtaagccgctacctggaagaactgaatttaaatgaagacggcgattatgtcatcgcctataacggagcgctcgttcaaaatacgcatactcaggaagttgtgtcagaactgacactgggctatgatgatgtgaaatcgttatatgagctcagccaaaagcttgatactccgatgcacttttttgattcggcttatttgtatacgccaaaccgggaaatcagcccgtataccgtttacgaatcatacgtcaccaaagtgccgctccggttccggacgatcgaagaaatcccgcaagatcttctggcgccaaaggcgatgtacattgatgagccggaaaagctggaccggacgatcgccgcaataccggaagacgtcaaggaacgctatacaatggtgaaaagttcgccgttcttttatgaaattcttcaccctgcggcaagtaaaggaaatgctgttcagcagcttgccgacatattaggcatcgcgcaggaagaagtgatgtgtattggagacaacggaaacgacatgtccatgatcgaatgggcgggttgcggagtcgccatggggaatgcgatccctgaggtaaaagcttcggccgattacgaaacgcgtacgaataatgaaaacggcgttgcccacgccattcgtgagcttgtattgtccaaataa

SEQ ID NO: 4085 - DNA, 1050 bp, Bacillus licheniformis
atgccgcgccaggttaccagcatagccatccccgcggttttggacattagtgagggcgtgcttggccggttggatgagatattgagaaaacatcagtttgacaaggcgatcatgttttttgacgatttttcctatcagcagtatgagcattcactgaaaaccgcatttcaacatgttaaagttgaagccgttctgctgccgtccaatctggacatacaggagcttttgaagcgggcattttcgatcgggaattgcgatgtcattattgccatgggcggcgggtatgttgtggactgcggaaaatacatcgccttttccaagcggaccccgttcatcagcattccgacgtcggcatccaatgacgggtttgcgagcagcaattgctcgcttcaggtcgaaggaaaaaaaacaaccgttccggcaagggttccctacggaatcatagctgatttgagcattattcaaaaagcgccggattgctttattttggcggggatcggagatttgatgtccaatattacggccctttatgattgggagtttgaggagcggcacggggtcggcgatgtaaatgcgtttgcgtcgatgctcagcaagaaagcggtcaacagctttgtccgtacgccgatgcaggatattaaacagccgatcttcttaaaagagcttgtcagttctttgacaatgggcggcatcgctacggaaatcagcggaaacagcgcgccgatcagcggttctgagcacctgatatcccacgccttggacaaaatttcgaaaaaaccgcagatgcacggcattcaagtcggggtagccacctacatcatggcccatgtacaggatcaccgggctgagcggattgaaaaggtgtttacgagaacgggctttttccaatatgtcaaaacgctgaatctgaacaaagatgagtttcgcgaggcgatcaatttgtcgcacactgtcaagcccaaccgctatacgtacttgcatgaagccggctatcgcgaaaaagcgcttcgcattcttgatgaagatccgattctgcaagaaatattttaa

SEQ ID NO: 4086 - DNA, 651 bp, Bacillus licheniformis
atgaagaaatgggcatttgtatcagactttgatgggacgatttccaaacaggatttttactggatggtcattgataaatattttcccgaaggccgtgaattgttcaagaagtggaagtccggagaattaaaagatatcgaatttttgggaaccgtttttgcttcgattaatcaaagcgaacaaaaaatcattgatgacatccattccataccgattgatgaatatgtgcctgacttcattcagcatgtccagaaaagcggcggcgacttctacattttaagcgccggcacggattattacattcattatattttaaagaaatacgggattacagacgttgaggtctattcaaataaaggcttttttaaagaagacaatgttcatatggacattgatgagaatcattggcattactctgagcgctatgggattgataaatcaaaggtcattcaaaagctgaaagaagagtatgagacggtttattttgcaggcgacagtgaaccggattcgcacccggctaaatttgcggatgttacgtttgcaaaggatgcgctccaggatttgctgcgtcagcagggggtgccatttgtagccgttgaaacatttgaagacattgaacaatatcttaaagaaaaagggcggatcgtctaa

SEQ ID NO: 4087 - DNA, 462 bp, Bacillus licheniformis
atggcagaaacgaacccggtgatcaaaaaattgcagttcaaggataatggacagcctgtactgattgtgaatccgcctgaggcatacagcggcgtcatcgctgaatttcaaggccctgttcatcatcacgccgaatcggaccaatatgattttgttcaggtattcgcagcgaccaacgcaaagctgcaggctttagccaaggaggctgaacgtcatttggcggaagacggtctgttttggctttgctacccgaaaaaatcatcgaaagtctacaaaggatcggactgcagccgcgatacagtagccggactgcttgcagaccagggctatgaaccggttcgccaaattgcaattgatgaagactggtctgcgctcagatttcgcaaggcggaaaacatcaaaacgatgaagcggaaatttgccgtaacagagaaaggtaagcagcgtacagatcaagaatga

SEQ ID NO: 4088 - DNA, 912 bp, Bacillus licheniformis
gtggtcagcgcctgcggaagcggcaatgcgtcaaacggtagcaaagaaaaagcggctgaagaaacgacaagaacatatcaatcaacgcgtggaagcgtgaagattccaacacatccaaagcgcatcgtgacagacttttatgccggtgaactgttcacggtcggcgccaatgtcgtcggctccggctcgtggtctttctccaatccatttttaaaggaccgtatgaaagatgtaacggatttaggcgacccgattaatgtggaaaaagtcatgaagctgaagcctgatttaattgtcgtgatgaacgatgataattacgacaaactgtccaaaatcgcaccgactgttgtgattccttataacacggcgaaaaatgttcaggaaactgttaagatgttcggcgacattgcaggagctaaagaagaagctgaacaattccttgccgatttcgaccggaaatcgaaagcagcgaggaaaaaaatcgctcaagtcgtcgacaaaaatgctactttcggtatttatgaaaacacagaaaaaggccaattctgggtgttcaatgacaacggcggccgcggaggccaagccgtgtacaacgcgctcggcttaaaggcgcctgaaaagattcaaaaagacatcttcaaaaaaggcgaaatcaaagaactttccttggaagtcgtacctgaatatgcagcagactacatgttcgtgacagactataacccgaacggcgacagcaaaacgctggacaagctgaagcagtcttccatttggaaaaaccttgacgccgtcaaaaacaaccgtgtctttatcaacgactttgacacgttctatccgtacgatccgatctctgtcagcaaacaggttgatttgattacggagatgctggtgaagcgcgaaaaggagaataagtaa

SEQ ID NO: 4089 - DNA, 402 bp, Bacillus licheniformis
atgaatgaaaataaaaaggctgaacaggagagaaaaattggatttgaagggtttgtgctccttctttcactgatttttatttccatttttatcacgacagcatacgaaataccgagcaatctgttgctgatcattctatttttcatcggcagcggctactattctattaggctcgtgagcaaaggtctgttgagaaaaaagaggggactcggctttaaagctgcgttttctgcctttgtcgtttggatggcattatcttttttgtttcatgacatttcatatccatttagtttgaaagggttattatttcaaatcatgatgttttttcttttctacattcctttctatttgatctttcaatttgcttttaggttttcaagcattcaagaaagaaaacaataa

SEQ ID NO: 4090 - DNA, 369 bp, Bacillus licheniformis
atgggaattgaaaaggttggacaaatcggggtgccggttcaagacttggagcgggctgcggcattttatcaggatgtattgggcctgtcccttttatttcagacagatcgcatggctttctttgagtgcggcgaagtgcggcttcttctcagccttccggaaaaagacgaatttgctcatgcaggctccgtcatttattttcaagttgaagatttgccggctgtatatgatgaaattgcaacaaaaggcgtctcttttccaatagagccgcatgtggtggcgaaaatcgagcaaacggaaacctgggtggccttctttgaagataccgaaggaaataccctagctttgatgagtgaggtgaacatataa

SEQ ID NO: 4091 - DNA, 159 bp, Bacillus licheniformis
atgctgtttaatattacgatcggagcgcttatctttagttatgcggcatggacgcttataaaatttgtcaaacgaagccggaaaggaaaatgcgccgcctgtgaattaaatcgcacctgtcaatcggcttgtgatgatgtaaaaacgaaaaacagctga

SEQ ID NO: 4092 - DNA, 2013 bp, Bacillus licheniformis
atgaacagccggcagattgcccttttcggaaacccgaatacggggaagacgtcattgtttaatgcgctgacaggctcctatgagtatgtcggaaactggagcggggtgactgttgagaaaaaggtggggctgctccgtcataaacaaggaatgatagtcgatctccccggtgtttatacattgagtccgctgtcccgcgatgaaggggttgtcacagacttcctgctcaatgattcattttcagatatattgaatattgtcgatgcatcacagttaaagcggaacttgcacttaaccgtgcagctcctggaatttgggcatccgcttacgatcggtttaaatatgatcgatgtcgcaggacagcgcggcgtcttcattgatcatcaaaaaatgtctgatgcgctaggtgttccggtaattcctgtgattgcccgcagcggcaaaggatgtgatgaactgagcaggcatttgctttttgaaaaggaaaagagggcggagccgctcgtcatcaattacggaagcgcagtggaagaagcgattggccggatcgaatcgatcatacccgaactccccggcgttttaaagcgctggatggcccttcaatatttggaaggcaactcgaaaatgaaagaacagctggaggacgcggccgacagcgaaagattaaaggaaatttacgaggagaccgaaaaacgccttcatcaggagcattccgtaagatcgctgcatcagcatatttacaatgagagatcgcgatggattgaccgcatcttgtcaacttctgtgcaatatcagtcagagcgaaaactgacgctgactgaacgcgtggatcagatcgtaacgcatcaggtgcttggcatcccgatttttttgttgttcatgtatctcatgttcatgctgacgtttgattggtttggcgttccattgtctgatgcactggacggtttcatcgggggaccgctgacggaatggacggcctcggcgctgtcggcaatgggagccagcccgtttatcgaggcgcttattctcgatgggattattgccggtgtcggcggtgtgctcgtgttcgtcccgcagatctttatcctgtttttcttcatttcggtgcttgaagattcaggatatatggcgcgtgtggccatggtgatggaccgcctgatggaggcgatcggtttaaacggcaaagcctttattccgctgattatcggcttcggctgcaatgttcccggcgtcatggctgcgcggactgtagagcagcctaaggaaagactcttgacgattatgctgacgccatttatgtcctgttcggcaaggctgccggtttatgctctgtttgcaggggcttttttcgcggcccaccaggctttcgtcgtcctttccttgtatgtgctgggcatcgccgcagcgctggtgctggcgaagtttttatcctcatccaagctcaaagaagaaaagtcgttcttcgtgattgaactgccgccgtaccgtttgcctcaagcgcgtacattgtggcgggcaacatgggagaagggcaaaggcttcgtccgcaaagccggcacttacatttttggcgggtctgtcctcatttggcttctgtcgtatacgggacccggcggaacggacgttgcgatggatgacagttttttagcgatgatcgggggagtgctcgcaccgctattgctgccgctgggattcggcacatggcaggcagcggcatcactattaaccggttttctcgcgaaggaagttgtcgttgcttcgatgagcatcatctattttgtacccgaagcccagctgcaaggcatgatggctgaacaatttacaccgttggccgcttacggatttatggctttcgtgcttttatacgtaccatgcctcgcgacagtagcggtgattaaaaaagaaacaaactcgaaaaagtggatgttcttgtccattgtttacggactggccattgcatatgcgatcgcgttcctgatttatcagggcggacgactgcttgggttatcatag

SEQ ID NO: 4093 - DNA, 228 bp, Bacillus licheniformis
atggttttagccgaattaaaacaaaaagagagagcaagaatcatagatttttcagacgtgaatgaacttgttcagcgcagactcatacagctcggaatgaaagaagatgatgaaatttgcgtgaagcgcaaattgccgtttggcggtccgttcatgttcgagtcaggcgggcagtgtctcggcatacggcttggagaagcaaaaaagatcaggattgaaaagctatga

SEQ ID NO: 4094 - DNA, 1089 bp, Bacillus licheniformis
ttgcaagtaaaagaaatttttgtcattcgctgcatctcctgtttaagcgttgttttgcttcatgcgatatcaatggtgctcatggtgcgggcggacatgctcggagatgcggttttccgggttgttgaatctttcagaacgctcctgatgttcagtacgccggcgtttattttcatttccgaatttttgctcgcgcatgcctatcctggtggtgttccggaagggtttttaaaaaagcggtttaaaacaattttcatcccttttctatttatcgctgttttggatgcttttatgaccgcaggtctgatgatgcagcaatttcatgcatcggtcattattaaaaaactgttggcgaatatattcttggggaatttcatcggttacttcattctcgtcatttttcaattttacttgctgcacatgtgcttccattcatttttgcaaaaggcttcgcctaaatgggtgctttcgatttcttttgcggtcacagcggcttatttgagctatttcacgttcattcaacctccggtcgttcaggaggaggcgccgtttcctttttcgtgggtgccgtttcccggctggctcttttacttttgtttggcctattattgcggcaagaattacgagcgctttttggcattgctggaacggtacaggcatgcggtgtatgcggcggctgctgtgaccggatgtttcattgtagcggtttcctacttcggccaagacatcgcggtgacgtcaaagcgtccggatatcctgctttattcgacaagcatcattttcttatgcttccacctgttttcaaaactgaagtcggtaccgaagctgattatgatgatcagcaactattctttttctatttatttactgcacgcttttatcctgattttcgggttggtcatcttaaccgcccttgacagcatcggtacggtatcggctgttttgcttttgtttttcatttctacaggcgctgcggttttcatatcctgggccgtcaataaattgaagtacggctatatgtttgtcggaaaaatttatgtgccgaaaaagaggcgaatggagcaaaaagtgcgccatcatgcaggttaa

SEQ ID NO: 4095 - DNA, 1887 bp, Bacillus licheniformis
atgacctttcgtcagttcgcgtttaacaatgtcattcgcaacaaaaggctgtatgccgcttattttctcagcagcatgtttacggtgatggtttttttcgcatttgcgatttttgctttccacccggtgatgaccagtgattctttgacttccggcatcgggcagcatgcatcctttggcctgctggtcgccggcggcattatttttgtcttctcttttttctttgtgctgtactcgatgagttcatttcttcaatcgagaaaaaaggaattcggcgttttaatgattcaagggatgtcgatgcgccaaattcgcatgatggtatttcttgaaaatatgctgattggattttttgcgacaatcggcgggattgtgctcgggctcgtcttcgccaaattgatactgctcactgcggaaaatgtcctgattattgataacaagctcgatttttacttcccgttgatggcgatgattgtgacgtttatttcttttaacggtctgttcttatttatctcttttcttgtgtcgtttgtgctcaggagcgagaagctgattgttctgttaaaagggaacaaaatctccaaaggggagccgaaagcatctgccttgcttacgctggttgctgctgtgctgcttgccggaggctattacaccgctttgattgtcaaagaaggaggcgttcttgtggcgatggtgccggtgacgattgttgtcattatcggcacatatctgctgtttacgcagctgagtgtttatgtgatccgcaggctcaaaaaacgggaaaccctgttttggcggaaaacgaatatgattttgttttctgatctgtcttacaggatgaaagacaattcgcggacgttttttatggtggccattatctctactgtcgcattcagcgccattgggacgctgtacggtttccaaactctggtgacaaacggaattaaagagatgaacccgcatacgttctcatataagccgccggaaacaaacaaacacatcgaaaaagacgtggctttcatcaatgacacactggatgaaagaaatatcaaaacagacaaagcttcagctgtccttcaatatttcgatgtcggcggcaatgacatgctgattgtgaaagaatctgactataacaagtttgccgatctcgtcggagccgaccacgtcaagcttgaagacggaaaagcggcggctgccgagtatgaggtcaagatcggcttagagggagatgatgaccagcagctcccttcgtcaatcccttttgcaaatggaaaacaactgaaggctgatcaaacgatccgttcaaaagcgttatctgaacccagctattatattgtgacagacaaagatttcgcacagctgaaaaaaccgaaaagcgaaaaccggttctatgcatggcaggcaaaagaagctgacggcatggctttagtgaaagccggggaggctttgcaaaagaaactggattacatgtatttcggggctgtagattatgaggtatataatataagcaaagggtatggcccgatattatttgtcggactgtttatcggaatcgtcttcttcgtttcagcaggaagcttcctctatttccggttgtacactgatttggacgatgataagcagaaattcaaatcgattgccaaaatgggcttaacagaccgcgaactgcataaagtgctgaacaggcagatcggcatcttgttcttcgcgcctatcgctgttgcccttgtccatggagctgtggcgctgaccgctttatcgcatgcctttcagtacaacctcttcaaggaatctgcaatggtgctcggcgtgttcttcgccatccaggtcatatattacttcatcgtccgcttctactatacaaaacagataaaagcggcgatttaa

SEQ ID NO: 4096 - DNA, 765 bp, Bacillus licheniformis
atgcttcaggtcaaacaagccagtaagatttacgaaggaaaaattgcgtaccgcgcgttaacagatattaacctaacaattgataaaggtgaattcgtcgggatcatggggccgtcgggaagcggaaaaacgaccctattaaatatgattgcaacgatcgatgagccgacgacgggcgaaatattgatcagcggccaaaacccgcatgttctcaaaaaagaaaaattggctaaatttcgccgcagagagctgggatttgtgtttcaggactttaatcttctgccgacattaaccgttgaagaaaatatcgtacttcctttgacgcttgacggcgaaaaggtcaaggaaatgaagcggagggcaaacgaattggccgaaaagctcgggattacccagatcatgaaaaagcgcacatatgagatatcgggcggtcaggcccagcgcgccgctgtagcaagagcgatgattcattcgccgaagcttctgcttgccgatgagccgacaggcaaccttgattcaaagtcatccaaagatgtgatggaaatgcttgagtcgatcaaccgcaatgaaaaagcgaccatgatgcttgtcacgcatgaccctcaggcggcaagctattgcaaccgggtcgtctttattaaggacggaaagctgtattcggagatcaaccgcggcgataaccgccaagcgtttttccaaaagattctcgatacactgtccttgttgggaggggatgcaaatgacctttcgtcagttcgcgtttaa

SEQ ID NO: 4097 - DNA, 1008 bp, Bacillus licheniformis
atgaagctttttttcaaagagcactatttgttgattgccgtgcaggcgctgcagtttatcacaatgctgtcagtgtactggcttgatgggtatcagcacatcagaccggctttttatgccgtttttctcggctttttctttcttggcttctatcttttctaccattactatacgcgccggaagttctacaaacggatgacgagcgggctggagtcattggatgacaccttcaggcaatcgaatcagccccaatcccctttgtcggaagcgcttgaacagctgctgaaaagccagtacaagcaataccgccaagaattaaagaagctggagcttggccaaaaagagcatttgactttcatggatcaatgggtgcaccaaatgaagacgccgttgtcggtcatcgaactgacggctcaaaatttggatgaaccggaatcatccagcatccgcgaggagaccgagcggatgaaaacgggcctcaatacgattctctatatggccagactgcggacgatcgaacaggatttccgtataaaaccggtcgcattggcggatatcgttcacgaggtcaatcgcgaaaataagcgcttttacattcgcagtcaagtttatcctaagttcaaagaaatcaaaaaaggcatcaccgtcgaaacagatgaaaagtggctgtttttcatcatttcccagtttgtcaacaatgcggtcaaatattcggcggggaaaagcaatacagtcattatttctgtatacgaaaatgattcggaagcggtattggaagtggcagatttcggcgccggcatcccggatacagatcaaaagcgggttttcgacccgtttttcacaggagaaaacggacgccgtttcagagaatcgaccggaatgggtctttacttggcaaaatcggcggctgaccagctcggccaccggatcgaacttgattcacaagaagggaaaggcacgacaattcggctgattttcacggctacgcaaaaccttacatcgatgtaa

SEQ ID NO: 4098 - DNA, 708 bp, Bacillus licheniformis
atgcaaaaagtgatgattgtagaagacgacccgaaaattgcagatttgttaaaatcgcatattgtcaaatacggatacaacgttcatgtagtgaaagactttgaccgtgtcatggatgagttcagaagcacggcgcctgatcttgttctgcttgatattaacctgccgagctttgacggctactactggtgccggcaaatccgccaggaatcgatttgccccgtcttgtttatttctgcgcggacaggtgaaatggatcaggtgatggcattggaaaacggcggagatgactttatcaccaagccgtttcacgccgagatcgtcatggcaaaaatacgcagccagcttcgcagggcttacggcgaatacgcggcgaaggcggaggaacggctgctggaaaaagaagggctgcggctgtatccggaaagacttgaactgacatttgccggtcaaacggctgctttgacgaaaaaagaagcggatattattgaaagcttaatggaacgccatccgagaatttcaggccgcgaagatttgctggccaagctgtgggatgatcaggcatatgtggatgaaaacacgcttaatgtcaacattacgcgcgtcagaaaaaaatttcaggagctcggtattgaagatgcagtggaaacagtgcggggcgcgggctatcgcttgaatgtatcctgggtgaaggcgggagaggaatga

SEQ ID NO: 4099 - DNA, 372 bp, Bacillus licheniformis
atgaagacacgggcgggcggcctgattgccgcggttctgatcgccgttgccggcgtttttatcctgcagaaagcgacaggaggccttgtgccgctggccgatgattatatacaaggccagggaaagcctgaggcttattatctcaaagctgaggatcatgcagaaaagccggataacggaaagtacaactacacattaaccggctatgacgcgagcggacacaaacagcagattgaggcagaggcagacgaaaaactgcatcccggcgctttcatcaaagtattggcgtacggaacgaaagccaaaagcttgactgaagtacacgaagaagaaatccccgagggcgctttggctgccatgaaaaccaattaa

SEQ ID NO: 4100 - DNA, 1686 bp, Bacillus licheniformis
atgaaagtgaaaacaaaactgctgggaatcatatcaattctagtcgtttcaatcctcggaatcggaatctcctctgtttttatgatttcttctacggtgaaaaagaatgaagaacttaaggacaagatggaatttcaaaaagagattaagcatattcaataccgtctgaccggcttgtcgaatgacgagagagcccttattatgaccggagacgatgaatacagtgaaggaatgaaggacaaggccgacgatgttttaaagagtcttgaccgggccggaaaactgatccgggaaaaatcatacaaagcgaacgtcgaagaaattaaagaaaacttcaaggcttattgggatttaaatcaacaagtcatgcagacttacgcttcaagccttaaaaaagcggaatcgatccatttcggagaggaaagaacattaagaaaagatgtcctcgatccgtctgtcaatcagctggtcgaaagcctggaacaagaggtggatgatctgaaagcagagatcagagccaatgggacgatgagcgaatgggtcatcatcgctgtcacaggagtatcagcgatattgggaattgttttgagtctgctgctcttgaagtctattctggtaccgttgagaagcctgaatcagcagcttgaggacatcgcccacggcgaggcggatttaacgaaaaaagtgatcgtcaaaaataaagacgagttcggccagcttgccaattctttcaatgcttttgtccagtcgctgacgcaaattgtgaagcagatcagcagctcgtctgagcaagtcgccgcatcctctgaacagttgtccgcaagcgcggaggaatcgaaatcgacttccgaactgatttccgaagagatgcaggcgatcgccgacagcaacatgacgcaaagcgaaatgacagaaaagagttcagaagcaattcatgaattgctggaccgtttatcatccgttgcctccaatacaggcagcatagcggatctgtcgtcttcgatgagagacaaagccgaaatcggctccgagtccgttcataaaatgctcgaacaaatgaacttcattgataagtcagtcgactcggccggcagcggcctgcaggcgctcgtgtccagcacggcggaaatcagcaacatttcttcgctcatcaccgatatttcggagcagacgaatttgctggcgctgaacgcggcaattgaagcagcaagagcgggagagcaaggaaaagggtttgccgtcgtggcggaagaggtccggaaattggcggacgaaacgaataagtcagcgagccacattcaatcattggtcacaacgatccaaaatgaatcggtagaaacggtaaataatattaaagtcgttcaagaaaatgtcagctccggtatagctttgtcgcaggagacgaccggtaatttcaacgaaattttaaacttggtggaacaggttgcttctcaaatccaagaagtcgcggcttctactcagcagctgacatcaggtgtcgaaatggttcaaaacaccattcaaacattggcttccggatcacaggaaacgtcagccagcacaaaagcggttgcttcctcaacccaggagcagctggcttcaatggaagaaatctcatatgcagcggaatcgctgtcccaattggctgaagaacttcaaaccattatcaatcgatttaaatattaa

SEQ ID NO: 4101 - DNA, 1425 bp, Bacillus licheniformis
atggatatcttagaaatactaggcaagattaataaggtactatgggggccgcccagtttaattttattatttgggacaggcttatttttaacgattgttttaaaaggactgcaatttcgccgcctgatctatgcgtttaagatcgggtttggcaaagaagacagcaaagacgcggctgccgaaggggatgtgagccattttaaggctttgatgacagcgctcgccgctacgatcggaaacggaaatatcgcaggtgtcgcgacggcattgacactcggcggaccgggttcgatcttttggatgtgggttgtcgggctgttggggatggcaacgaaatacgcggaagccttgctggctgttaaattccgcgtaaaaaatgaaaaaggggaatattcaagcgggccgatgtattatatcgaacacggactcggccgcaaatttaaaggactcgccatcgcctttgcgctgtttggagcttttgccgctttggggataggcaacagtgtccaatccaatacgatcgctgatattacgaagaacagcttcggcatcgaaaactgggtgacagggctgattctcgtcattctcgtcagcgtcattatcttcggcggcatccagcggatcagcaccgttgccagcttctttgtgccgatcatggcttttctttacatgggcggggcgatcttgattctgattttgaattatgacaagattattccggcttttgcgctgattttttattatgctttccaccctgtagcggcagccggcggcttccttggaattgccgtatctgaagcggttcggaacggggtatcccgcggtattttctcaaacgaagcaggccttgggacggcggcgctaatcgccggaaatgcgcgcgcagaccatccggtaaaacaggcgctcgtcgcaatgaccgggacatttatcgtgacgatcgtggtgtgtacaatgaccggtttaacccttatcattaccggtttctgggacccgtccggcggcttgatatcaggcgtggcccataatgccagcctggaaggcggggcattgacaagcgcagcttttgcttcagtactcggcgcggcaggcgaatacattgtgtctctgtcggtcattttctttggcttctctacaattgtcggctggtatgtttacggagaaaagtgcttcgaatatttggcaggcgccaaaggaattgcgggctacaggctggtctacatcctcgcctgcggcatcgggacggttgccaacctcgtcaccgtctgggcgtttgccgatatggcgaatgcgctgatgatgattccaaacctgatcgccatcctgctgctttggaaagtcatcaaagcagagacaaatgattattttcaccacttctatgaacataccaaatcggcgggcccgccaagtaaaccaattcattaa

SEQ ID NO: 4102 - DNA, 1131 bp, Bacillus licheniformis
atgatcattggaattcctaaagaaattaaaaacaacgagaaccgtgtagccattactccggccggagtagtcgcgctaaaaaaaagcggtcatcaagttttaattgaacagggagccgggcttggaagcggattcgaggacgccgactacaaagcagccggggcggacattttggctgaagcgaaagatgtgtggggaaaagcggatatggtcatgaaagtgaaagagccgatcagctctgaatacggctatttccgaaaaggacttgttttatttacttatctgcacttagcggctgaacctaagcttgcgaaagcgcttgtggacagcggcgtcacagccatcgcttacgaaacggtcgaagtgaaccggacgcttccgctcttgactccaatgagtgaagtcgccggacgcatggcttcgcagatcggcgcgcaatttcttgagaaatcaaaaggcggcaaaggcatcctgttatcgggcgtacccggtgtaaaacgcggcaaagtcacgatcatcggcggcggagtggttggtacgaacgctgccaaaatcgctgtcggacttggcgctgacgtcactttgatcgacttgagcgctgagcgcctccgtcagctcgatgaccagttcggcaaagacattcaaacgcttatgtccaatccgctcaacattgcggaagccgtaaaagactcagaccttgtcatcggcgccgtcttaattcctggtgcaaaagcgccgaagcttgtcacagaagagatgatcaagtcgatgtcgccaggttcagttgttgtagacgtggcgattgaccagggcggcattatcgaaacggttgataaaatcactacgcatgacgatccgacttacacgaagcacggcgttgtccactatgccgtcgccaatatgccgggagccgttccccgtacatcaacgatcggcttaacaaacgtcaccatgccttacgccttgcaaatcgcaaataaaggcgttgaacaagcagtcgccgaaaatcaggcgctcgctctcggcgtcaacgttgcaaacggaagcatcacctacaaggccgtcgcgcgcgaccttggatatgaatatgtatctgtagaagatgcatttcaaacggtaaccgctggttaa

SEQ ID NO: 4103 - DNA, 1278 bp, Bacillus licheniformis
ttgatgaagaacgtgctggctgtttttgtggtgctgatatttgttttgggcgcatttggaacaagcggtccggcggaagccgccagagattcagggacggcaaaaagcggcctttatgttgaaaaggtttcagggcttcgcaaggattttataaaaggggttgatgtttcgagcatcatcgctttggaagagagcggcgtcgccttttacaatgaatccggaaagaaacaggatatattcaaaacgctgaaggaagcaggcgtcaattatgtccgggtgcgcatatggaatgatccctatgatgccaacggcaacggctacggagggggcaataatgatctggaaaaagcgattcagatcggaaaacgggccactgccaacggaatgaagctgctggcggatttccactattccgatttctgggcggacccggcgaaacagaaagcgccgaaagcatgggcgaacctaaactttgaagataaaaagacggcgctttatcaatatacaaaacaaagccttaaagcgatgaaagcagcgggcatcgacatcggcatggtgcaggtcggtaacgaaacaaacgggggccttgccggtgaaacggattgggcgaagatgagccaattattcaacgccgggagtcaagcggtgcgagagacggattcgaatatcctagtcgccttgcattttaccaatccggagacgtcaggaaggtacgcttggattgccgagacgcttcatcggcatcatgtagactacgatgtgtttgcaagctcgtattatccgttttggcatggcacgctgaagaatttaacatccgtcctgacatctgtcgcagatacgtacggcaaaaaagtcatggttgctgagacatcttatacgtatacggctgaagacggagacggacacggaaatacagctccgaaaaacggccaaacgctgaataatccggtcaccgttcaagggcaggcgaacgcggtccgtgatgtgattcaagcggtcagcgacgtaggtgaagccggaatcggcgttttctattgggaaccggcatggattccggtaggaccggctcaccggctcgagaaaaataaagcgctttgggagacatacggatcaggctgggctacaagctatgctgctgaatatgacccggaagacgcaggaaagtggtttggcggcagcgccgtagacaatcaggcattgtttgattttaaaggacgtccattgccgtcgcttcatgtgtttcaatatgttgatacgggaacaccattcaaaaattga

SEQ ID NO: 4104 - DNA, 2055 bp, Bacillus licheniformis
atgccaaaaatttatacgacccaagcaagatacatgcttcacgggggagactacaatccggatcagtggcttgaccgtccggatattcttgcagatgacatcaagctgatgaagcttgcccatacgaatacattttcagtggggattttttcatggagcgcccttgagccggaggaaggcgtctatacgtttgaatggctggatgatatttttgagagcattcaccggaacggcggccggattatattggcgacaccgagcggcgcccgtcctgcttggctgtcgcaaaagtatccggaagtgctgcgcgtgaatgctgaacgcgtcaaacagctgcacggcggaaggcacaatcattgcttcacttcatacgtataccgtgaaaaaacgaaagagatcaaccgcatgctggctgaaaggtacggcagccagcatgcccttttgatgtggcatgtttccaacgaatacggaggagaatgccattgtgatcaatgtcagcacgccttcagagactggctgaaaaagaagtacaaccatgatattaaatctttgaatgacgcatggtggacgcctttttggagccacaccttcaacgattggtcacagattgaatcgccgtctccgatcggggaaaatgcggtgcacggcttgaatttagactggcgacgcttcgtcactgaccagacgatctctttttttcaaaatgaaatcgttccgttaaaggaaatcacgccgaatattccgattacgaccaattttatggcggacacgcatgatttaattccgtttcaagggctggactacagcaagtttgccaagcacctggacgtgatcagctgggacgcgtatcccgcctggcacaacgattgggaaagcacagcagatttggccatgaaagtcggctttatcaatgatttgtaccgcagcctgaaacagcagccgtttctcttaatggaatcgacgccaagcgctgtcaattggcacgattttaataaagcgaaacggccgggcatgcacctcctgtcttctgtgcagatgatcgcacacggatctgacagcatcctctattttcaatggcggaaatcccgcggctcatcggaaaaatttcatggtgcggttgtcggccatgacaattgttccgagaaccgcgtgtttaaagaagtggcaaaagtcgggcaaacccttgaagcgctgtctgaagtcaccggaacgatccggcctgcggatgtcgcgattctctacgattgggaaaaccattgggcgctccaagatgcacaaggattcgggatgaaaaccaagcggtatccccaaaccctgcacgagcactaccgcgcgttttgggagcgtgatattccagtcgacgtgattacgaaggaacaggatttttcatcgtaccggctgctgatcgttccgatgctttacttagcaagcgaagaaacaatcgcgcgcttaaaggcatttgctgccaacgggggcacattggtgatgacctatattagcggaatcgtcaacgaatctgatctgacctatttaggcggatggccaaaagatctgcaagagatgtttggcatggagcctgttgaaaccgatacactctatccgggcgataaaaatgcggtccgttatcaaaaccggtcgtatgagctgaaagattacgcgaccgtgctgaagctcagtacggcagatcccgagggattctatgaggacgacttttatgcggacacgacggctgtgacgagccatccatacaaacaggggaaaacgtattatatcggtgcgcgtttaagcagccaatttcatcgggatttttatggaacattgattaaagagctagcgattcaaccggctcttgacgtgaaacatcagcctggcgtctccgttcaagtcagacaggatgaggaaaatgactatattttcatcatgaatttcacggaaaaacgtcagcccgtcgtgttggcgtcggcagttaaagatatgctgaccggagaaacgctggccggcgaagtcacattggaaaaatatgaggccagaatagcggtaaaagcaaaagaatag

SEQ ID NO: 4105 - DNA, 840 bp, Bacillus licheniformis
atgaagaaaagaagattctttcggctccttctgacctattctctgttggcttttatgacagccgttatcatataccctctgctttggacggtgggggtcagctttaatcccggcaacagtttggtcagcacttctatcattccggcaaatccgacattggatcactataaagaattattcgccggcaaagagagcctccaatacgggcaatggtatataaactcgctgaaaatcagcatctttacgatgatcggatcggtcatcagcgtttcttttacagcttatgctttttcacggtttcgttttaaaggaaggaaaaacgctttagttttattcttgctgctgcaaatgattcctcaattttcggctttggttgcgctcttcgttttagcgcagatgcttggaatgatgaacagccattggctgctgattttgctgtacatcggcgggctcataccgatgaacacgtatttgatgaaagggtatatggactccattcccatcgatttggatgagagcgctaagattgacggcgcaagcaatacaaggattttcctgcagattattatgccgctatccaaaccgatgatcgcggtcgttgccatgaacggattcaccgggccgctcggggatttcgttttgtcttcgacgatattgcggacaccggagtcgtatacattgccgatcggtttatacaatttagtcaatgaggtgatgggagccagctatacgacgtttgccgccggcgctattttgatcagcataccggtagccgtcatctttatcatgctgcaaaagaactttgtgtcaggattgacggcaggcggaacgaaaggatag

SEQ ID NO: 4106 - DNA, 1257 bp, Bacillus licheniformis
gtgcagcatcgcaaaaaagctttactattatcaattattcccggtctgggccaattctacaataaacaatggataaagggtctgttattccttcttttaggcgtctcgttctttgcggtttttggcgatttgctgaatatggggctgtggggcctgtttacgcttggaaccgaagtgccgcgcgacaactcgatttttctattggcaaaaggcattattgctgtgattgtcacctgttttgggctggctgtctattacgccaatttgcgggacgcctaccaaaacggaaagaggcgcgatgaacaaaaggagctcagttcactcaaggaacaatatcataatttaatagctcagggatatccgtatctcatcagcgggccatcgctgttcatcctggtttttgccgttgtttttccgattttgttcagctttgcattagcttttacaaactataacctctaccattctccgcctgcccgccttgtcgattgggtaggaattaaaacgttttccgaaattttcaccgttgatatttggcggtcgacctttttggatgttttagcttggaccattgtttggacgcttgtcgcttccacgctccaagtcgggttgggaattttgttggcggttgtcgtcaatcagaaggaagtccgctttaaaaaaattttccggacgattcttgtcttgccttgggccgtgcccggttttgttaccattctcgtgtttgccggcctttttaatgacagcttcggtgctttcaatcatcaaatcctcgccgcattcggcatcgatccgattccttggatgacgaatgccaattggacgaagctggcgcttattcttatgcagggctggctcggatttccgtatgtgttcattgtaacaaccggtgttctgcagtcgattccggatgacctttatgaagcggcgacgattgacggagcgtctgcgttttcgaaattcaggcatattacactgccgctgattttaatcgcgatggcgccgattatcattacgcaattcacttttaattttaataacttcaatattatttatctattcaatggaggcggtccggctgttcccgggtcaacagcgggaggaaccgacatcctggtgtcctggatttacaaattgacgatgcagtcgagccagtactctttagccgccgcattgacgatcctgctgtcggtctttgtcatctcaattgcactgtggcagttcagacggacaaattctttcaaagagggggcttaa

SEQ ID NO: 4107 - DNA, 1269 bp, Bacillus licheniformis
atgatgaatatgaaaaaatatgttggaatcagcagtgtcattgctctcagtttgtctttaactgcctgcgggcctaaagagagcagcaatggagcatcagactcgaagcaaaaggaactcgtggtctgggaagataaagagaaaagcgaaggcattaaagatgccgtcgcccaatttgaaaaagagcacggcgtatctgtcaaagtcgttgaaaagccttacgcaaagcagatcgaagacttgcggatggatggaccggcgggaacgggtccggatgtgttaacgatgcccggagaccaaatcgggacagcggtaacggaaggtttgatcaaggaattaaaggtggacaaagagatccaatcgatctatacggaacctgccatgagatcgcaggtgacaaacggcaaggtctacggcctgccgaaagcggtcgaaacgacgatgctctactataataaagatttaatttctgaaaaagaactgccgaaaacgctggatgaatggtatgagtattccaaaaaaacggctgacggcaaaaaattcggcttcctggcgctgtttgaccagatttattatgcacagagcgtcatgggagggtacggcggctacatttttaaaagcgatgccgacggcacttatgatccggccgacctaggcttgaacaacaaaggtgcagtcgaaggcgccgagtacattcagaagttttaccaagaggggctgttccctgccggaattattggggagcagggcatcaatgtgctggaatcgctgtttacggaaggaaaagcagcagcgatcatttcaggcccgtggaacctggaaccgttcaaaaaagcgggtatcaattacggggttgccaagctgcctaaactgtccaacggcaagcatatgagttcttttgtcggcgtgaagagctacaatgtaagcgcttattcgaagaatgccgatctagccgaacaattagtcgtcttcctcgccaataaagaaaactcaaagaagagatatgagatcacaaaagaagtacccgcagtcaaagaactggcggatgatcctgccgtcacaaaaagcgaagcggctcaagccgttgccgagcaatctcagtactcagagttgacaccgaatattcctgagatgaatgaagtatggacgccggcggatgcggctctgcaaacaattgcaaccggaaaagccgaaccgaaaaaagcgcttgatcaagccgcggaaacgatacaaggacagatcaaagcgaagcacagcggcagcaaataa

SEQ ID NO: 4108 - DNA, 993 bp, Bacillus licheniformis
gtggcgacgataaaagatgttgcagaaaaggcggggtattccatctcaacggtttcccgcgtattgaataacgacgaaagcctttccgtacccgatgagacgcgggagaaaaaatttgaagtggcggaaagcctgaactaccgcaagaaaacgatcaggacactggtaaaaaacatcgcgtttctgtactggctgacggataaggaagagctcgaagacgtgtattttaaaacgatgaggctggaaatcgagaagctcgcaaagcaattcaacgtcgaactggcaacgtataaaatttcgggaggcattgacgccattcccgaaaacatagaaggattcattgccgtcggctcgttttcagatgatgaattaatccgattaagacagatgacgcctcacggtgtatttatcgattcgacgcctgatccgaatcactttgattcagtcaggccggacttaaagcagatgacgaggaaaacggtagattttctcattgagaaagggcatgaaaagatcggctttatcggaggtacgtaccacaaccccaatacagatgaagacgaaatggacgtaagggaacgaacgtttcgcgaatatatgaaggaaaaagggctcttggaggaaagctttattttttgccggaggggtttttcggtggaaaacggctaccatctgatggacaaagcagttgaaacattgggagaaaagctgccgacggccttttttacagcggcggatccgattgccgtaggctgccttcaggccttaaatgaaaaagggatcgccatcccgggcagagtcagcatcatcagcatcaacaacatcagtgtagcgaaatacgtatctcccccgctgacgacattccatatcgatattaaagagctttgcaaaaacgctattgaattgcttttggaacaaatacttcaaaaaagaaaagctgtaaaaacgctatatatcggtgccgaactggtggtcaggaaaagcaccaattaa

SEQ ID NO: 4109 - DNA, 1170 bp, Bacillus licheniformis
atgaatactgcagccgctttatcaaacgactttcgttctatttttaagacagaaaagacaccgcgaaccttttttgctccgggaaggatcaacttaatcggcgaacacacggattataatggagggcatgttttccccgcctcgatttcatttggcacctatgcccttggcgtgaagcgcgatgatcaaatgatccgcttctattcaaagaacttccctgacaaaggaataattgaatgcagcttgagcgatttagcctttgaccagtccgacggctgggccaattatccgaagggaatgttccttttgacgaaagcggcaggccatcaaatcgttcacggcgccgatattttgtattacggaaatattccgcacggagcgggcctctcttcttccgcatcgattgagcttgcgacaggcgttttgttaaaagggctttatgatttgcagacagacacgatctccatggtgaagctcggacaaaaagtcgaaaacgaatacattggcgtggggagcggcattatggatcaattcgcgatcggcatggggaaaaaggatcacgcgattttgctagactgccgtacacttgattacacatacgctcccttcgtgttgaaagaacacgatgtgatcatcatcaatacaaacaaacagcggacgctggccgggtctaaatataatgaaaggcgcacccaatgtgaagaggcgctcggcgatctgcaacaggagttgtcgatcgcaagcctgggcgaattgacgatggaaggatttgaagcccatcagcacctcatcagaaatgaaatcaatcaaaaacgcgccaaacatgctgtctacgaaaatgcccggacgctgaaggcgcttgaaaaacttcgcgaaggcgacctcgccggatttggcaagctgatgaatgaatcccatttgtcattaagggatgattatgaagtgacggggctggagcttgatgccattgtccaggcggcctgggaacaagacggtgtccttggcgcccgcatgaccggcgccgggttcggcggctgtgcgattgcgattgtagaaaaagaccggacagacagctttaaagaacgcgtgaatgccgtctaccgcgaaacggttggctatgatgccgctttttatactgcggcaataggcgacggcgccaaagaaatatag

SEQ ID NO: 4110 - DNA, 1002 bp, Bacillus licheniformis
atgagcgtgttggttttgggcggtgccggctatatcggttcacacgccgtgtaccaattaatagacagaggcgaaaacgtcgttgtcgttgacaacctcgagaccggccaaagacaggcagtacatcctgatgcgatcttttatgaaggggatgtgcgcgatcgcgatttcctccgcacggttttcgaaaaggaacgtattgaagaagtgatccattttgccgccagttcacttgtcggcgaatcgatgaaagatccgctcaaatattacgacaacaatgtatccggaacacaggttttgcttcaggcgatgctcgagcacgatgtaaaaaaaatcgtattctcctcgacggcggccgtctacggagagcctgaatcgttgccgattacagaagacatgccgacaatgccgacaagcacctacggggaaacgaaactgatcatggaaaagctcatgaagcggactgaagaagcccatgggatcagctttgtgtctctcaggtacttcaatgttgcaggggcaagggagacgggagaaatcggagaagaccaccgtccggaaacacacctagtccccctcatcctgcagaccgctctcggccaaagaccgcatataacgattttcggcgatgactatgatacgcccgacggcacatgcatccgcgactatgttcatgttgaagacctcattgacgctcatctgtcggcattagactatttaagaaaaggcggcaaaagcgatatattcaatctcggcagcagcgaaggattttcggtgaaagaaatgattgatgcggccagaaaggcaaccgggaaagacattaccgccgagatcggcaagcgcagagccggcgacccgagcatcctgattgccggctctcacaaggcaaagcaagttctgggctggaggccttcgcgcacatctgtagcaaagattattgaagatgcatggaagtggcattcctcgcatccaaacggttacaggaaggaagtgtcaacatga

SEQ ID NO: 4111 - DNA, 1488 bp, Bacillus licheniformis
atgattgaacaagacatagccggactcattcaaaaagcgcttgaagcagggtttatcgaaccggctgacgtgaactacgcgcgcaaccaagtgatgaatctgctgggcttggaatcgtttcctgaggaagccactgctgcttccggcgactccatcccagaccttttggaaaaactcgcagcctatgcagtcgaacacggcgtgataaccgacgatctagacgcgaaagacatgctggcggcaaatgtgatgaactgctttgttgcaagaccttctgtcatcaatgcagtgttccagcagaaatacgaacaatcgccgctggcagccaccgaatatttttatcagctcagcaaaaacagcaactatatccagacgaagcgaattgaaaaaaatatttcgtatcagatggatacgccttacggcacaatggatattacgatcaatttgtcaaagccggaaaaagaccctgaacaaatcaaacgggagcgcgccgctgcaaaacaatcgcgcagctatccgatgtgcctgctgtgcaaagaaaacgaggggtatgcgggacgaatcgggtatcctgcccgggcaaaccacaggattattaaagtcccgctcgccggagaaaactggtattttcaatattctccatatgcttactataacgaacacagcattttattttctgagcagcatcggccgatgaaaattgataagcttgcctttcacaggctgcttgcttttactgagctgtttccgcattattttatcggatcgaatgccgatttgccgatcgtcggcgggtctattttaagccatgaccattatcaggccggacgatatgagtttgcgatgacgcgcgcggaaggcgcgttctcctttcaaatcaaacagcatccggccatcgaagcttccgttttaaaatggccgatgtccgtcatccgcttgaaaggaactgcgatcaacagccttgttgaagcggcggaccatatttttcagacttggaaaaactactcggatcaacaagcggatatctcggcttttacagatggcacgccacataacacgattacgcctatcgcaagaaacgtgagcggcgtttatgaaatcgaccttgtgctcagaaacaaccggacatctgccgagcacccatacggcatattccatccgcatgctgacgttcaccatattaagaaagagaatatcggcttaatcgaagtgatgggcctggccgtccttcctccccgcttaaagaccgaattggcggcagtgaaagaattcctgctcggtcagtcagatgccgttgaagcgcatcaccgggaatgggccgaacagctcaaaaccgaatacggagagctgtccgaaccggagcaggctgaatcaattgtacgaaaagaacttggcaagaaatttgtcaaagcccttgaggacgccggagtattcaaagaccgcgaagctttcatgcgctttatccgcacagtcaatcatcaggggtaa

SEQ ID NO: 4112 - DNA, 1173 bp, Bacillus licheniformis
atgcagcgcggtacatttcaattaatgaaatcggtgaacaaatcgatcattcttaataaaatcagaacatcagagccgatttcgagagctgagatcgccaaggaaacaaagatcacccctcccacggtctcaagcatcgtcaaagagctcatcggacaaggactcgttaaagaaagcacgctcggtcgttcgagcggcggaagaaagccgaccatgctccacatcaacacgggtgcctattatgtcattggcattgatgccgggcctgagacggtggagtgcgtcttaaccgatttagccggagggattttgcagcggacgtccagcctgctgaaaaaaccgctgacaaacgagaggttcatggaagttttaaaagaaagtgtctatgccattttgggacgtgccgatgtcgagcaagaaaagatcatcgggatcggcattgcaatgcacggtgtggtcgatgctgaaacgggaatgtcgcgcatcgcaccgattttaaacttaaccaatatccccatcaaagatgtgctggaacaagaattcaacttaaccgtaagagttgaaaacgatgcccgggcgatggcgcttggcgaatcgtggttcggcggccgcgatgacgcagggagcatggctgccgtgaatatcggccgcggcgtcggtgcggggatcgtcatcaacggaaaactgtaccatggagctgaagggatcgcgggtgaactgggccatatgatcattgatatcaatggagaaaagtgcgagtgcggcaaccgcggctgcctgcagacgattgtgagcggaaaagcaattgccgaacgggggaaaaagcggttgaaagaaagcactgacagcctgacagccaaagatttgtttgaaatggccgagaacggctgccaaacatgtatcgaactttttcaggaaaccggtgtgatcatcggaatcgggctgaccaatttcattcatcttgtcaatccgggcaaaatcgtgctgggaggaggagtgatgaagggcgggaggttcatattgccggcgatacgagaaacgatacagcagaaagctttaacagccgaagcgaggcagacagaagtgacgataacgaagctcggcgatgaagcgacgctttacggagccgtttcattgctgctggcggagctgtttgatccggtgctaaaataa

SEQ ID NO: 4113 - DNA, 732 bp, Bacillus licheniformis
atgagcgaatctaaaggccttttatatccggagaagtggctttctagagcttcaactggtgttcgcgtcgcatgcgagctgagaatgcgcattatttccggtttgattgaaagcggtaccattttatctgaaaataaattggctgcggaattctcggtgagccggtctcccatccgcgaggctttaaaaatactggcatcggaaaaaatcatccgtttggaacggatgggggccgttgtcatcggtttaaccgaaaaagaaataggagaaatttatgatgtgcgcctggtgatggaaacattcgtattcgaacggcttggacaggccaatgtcgacgaactggtaacagacctcagcaaaatattggagatgatgaaagtctccatcaaatacaaagatgccgacgagttctcatttcaagacgtcttatttcacgaaacgattgtccgctccatcaatcattcttacattttgatgatatggaacaatctcaaacctgtgatggaaagctttattcttttatccatgcgggcccgcttaaaagaaaaatacgaagactttgaacgaattctcgataaccatgaactttatattcaagcgatcaaaacgaaagacagggatctgatgcttaaatccctacatcaaaatttcgatgacgtacaaggtaaagttgaagatctatggctgtcgcaacaaatgctggcgaaaggagccgaacaacaaaatgactag

SEQ ID NO: 4114 - DNA, 1542 bp, Bacillus licheniformis
atgactagttatatgttaggcatagatatcggtacgacaagcacgaaagcggttttattcagtgaaaaaggggacgtgatccaaaaggaaagcatcggctacccgcttcacacgccggacatctcgaccgctgaacaaaacccggatgagatctttcaggccgtcatccagtcaacggcgaaaatcatgcagcagcatcccgacaaacagccgtcattcatttcattcagcagtgcgatgcacagcgtgattgcgatggacgaaaacgacaagccgctcacctcctgcatcacttgggcagataacagaagcgaaggctgggctcataaaatcaaagaagaaatgaacgggcacaatatctacaaacggacgggaacgccgattcacccgatgacgccgctaagcaaaatcacgtggattgtgaacgaacatcctgaaaccgctgccaaagcgaaaaaatatatcggaatcaaagaatatattttcaaaaaactatttgatcaatatgtcgttgatcactcattagcttcggcgatgggaatgatgaatctcaaaaccttggcctgggacgaggaagcacttgcgattgccggcatcacgcccgaccacttatcaaagctcgttccgacaacagcaattttccataattgcaatccggaactggcggcgatgatgggaatcgatccgcaaacgccgtttgtcatcggcgcaagcgacggcgtgctgtccaacctcggcgtcaacgcgattaaaaaaggcgaaatcgccgtcaccatcgggacaagcggcgcgattcgcacgattatcgatgagccgcaaaccgatgaaaaaggcagaatcttttgctatgccttaactgaaaaccattgggtcatcggcgggccagtcaacaacggcgggatcgtccttcgctggatcagagatgaatttgcttcatcagaaatcgaaaccgcaaaacgcctcggcattgatccatatgatgtcttgaccaaaattgccgaacgcgtcagaccgggtgccgacggactgctgttccatccatacctcgcaggcgaacgggcgccgctctggaatccggatgtgcgcggttcattcttcggcctcaccatgtcccataaaaaagaacacatgatccgcgcggcattggaaggggttatttacaatctgtacaccgtcttcctggcgttgacagaatgcatggacggtccagttgcccgaattcaggcgaccggaggcttcgcaaggtctgatgtgtggaggcaaatgatggccgatattttcgaatcggaagtcgtcgtgccggaaagctatgaaagctcttgtctcggagcctgcattttgggactgtacgcgacgggaaaaatcgattcgttcgatgtcgtctccgacatggtcggaagcacgcacagacacgcgccgaaagaagaatcggccaaagaatacagaaaattaatgccgatctttatcaacttatctcgagcactggaaaacgagtatacacaaattgcaaattatcaaagaagcttaaccagcaaaaaatag

SEQ ID NO: 4115 - DNA, 1347 bp, Bacillus licheniformis
atgccattattaatcgtagcaatcgggattgtcgcattattgcttttgattatggggttaaaactgaatacgtttgtttccttgattatcgtatcgttcggtgttgcattggcacttggaatgccgtttgacgacatcgtcaaaacgattgaacaaggccttggcggaacgctcggccatatcgcattgatcttcgggctcggcgccatgctgggcaagctgatcgcggattcagggggcgctcagcgcattgcgatgaccctcgtcaacaaattcggggagaaaaacatccaatgggcggtcgtcatcgcctcctttatcatcggggttgctttattcttcgaagtcggattggttttattgattccaattgtattcgcaatttcaagagaattgaagatttctattttatacctcggaattccgatgacggcggccttatccgtcacacacggcttcctgcctccgcatccgggaccgacggctatcgcgggagaactcggcgccaatatcggggaagtgctgctctacggtatcattgttgcaattccaaccgttcttttggccggacctttatttacgaaactggcgaaaaaaatcgtaccgcaatcatttgagaaaatgggcagcatcgcttcactcggtgaacagaaaacgttcaagcttgaagagacgccagcctttggcatcagcgtcttcacagctatgcttccagtcattatcatgtcgatttcgactattattactctcattcaagaaacaatgggacttgcagacaacagcttcctggcagcgattcgtttaatcgggaatgcctcgacttcgatggtcatctccctgttgttcgcgatttatacgatgggtatcgccagaaagatcccgatcaaacaagtgatggattcctgttcaaccgccattactcaaatcggaatgatgctcttgatcatcgggggcggcggcgcattcaaacaagtcttgatcaacggcggagtaggcgactatgtagctgaattattcaaaggaacggccatgtcgccgatcttgctcgcctgggtcattgccgcgattctgcgaatctctttaggttccgcgacagttgctgcattaagcacgaccggactcgttcttccgatgctcggacaaagcgatgtcaatcttgcactggttgtgcttgcaacaggggcaggaagtgtaatcgcttcccatgtcaacgacgcgggcttctggatgttcaaagagtatttcggcctgagcatgaaagaaacattcgccacctggacactgcttgaaacaattatcgcggtggccggattaggatttactttattgttaagtctatttgtataa

SEQ ID NO: 4116 - DNA, 1404 bp, Bacillus licheniformis
atgtgcaatacaatcggtgtcataggtttgggggtcatggggagcaatatcgccctgaacatggcaagcaaaggcgaacaagtcgccgtctataactacacaagggatttaaccgatcaactcgtccaaaaaacgggaggccaaacagtcaagccatactatgagcttgaagatttcgtacagtctttagaaaagccgcgaaaaatctttcttatggtcacagcaggcaaaccggtcgattctgtcatcgactcgctcgtccctctgcttgaagaaggggacgtcatcatggacggcggcaactcccactatgaagatacagaacgacgatatgacagtttgaaagtgaaaggaatcggctacttgggaatcggcatttccggcggcgaaatcggcgctttaaaaggcccatccattatgccaggcggagaccgggacgtctacgaaaaagccgctccgattctcacaaaaatcgccgcccaagtggatggagatccatgctgtgtctacatcggtccgaaaggcgcgggtcattttgtcaaaatggtgcacaacggcatcgaatacgcagacatgcagctcatcgccgaagcatatacgtttttaagagaaaagcttcttttgccgatagatgaaatcgctgacattttcgacacgtggaatcaaggagagctgaacagctatttaatcgaaatcacggcggagatcctgcggaaaaaggatgagaagacgggcgctccactcatcgacgtcatcctcgacaaaaccggccaaaaaggcacgggcaaatggacgagcctgcaggccgtcgacaacggcattccatcatcgattatcacggaatccctgtttgcccgttacctgtcatcattaaaagacgaacggacagctgcggaaaaagtattggccggacctgcaacagaagaacggcgcctggatcaaaacgtgtggatcgaccgcgtcagacaggcattatatatgggcaaaatctgcgcctatgcacaaggcttcgctcaatacaaaatgacatctgacctgaacggatggaacctgccgttaaaggacatcgccctcatcttccgcggcggctgcatcatccgcgcacaatttttaaatctcatcagcgaggcgttcgacaaacagccggacctgtccaacctgctggtcgcacctgacttcgctgaaaaactaaaagaataccagtccggcttgcggaaggtcgtctgcgaaggcatcagctcaggcatctcattcccgtgcctaagcactgccctttcctattacgacggctaccgcacaggccgctcaaacgcaaacctcctgcaggcccagcgcgattatttcggcgctcacacgtatgagcggacggatatggaaggcgtgtttcatacggactggtattaa

SEQ ID NO: 4117 - DNA, 2604 bp, Bacillus licheniformis
atggcaatcgaagaaaagaacatgaaacaaaagcaaaatgcctcaaacatgattgatcagctagtcgaaaaaggcctaaaggcattggaagaattccgcagctttgatcaggagcagattgatgagatcgtcaaacagatggcgcttgccggccttgatcagcacatgcctctcgccaaacttgccgtcgaagaaacgaagcgcggcgtttatgaagataaaatcattaaaaacatgtttgccacagagtatgtctaccatcatatcaaatacgataaaacagtgggcatcatcaatgaaaacgaacacgacggagtcattgaaatcgcggagcctgtcggtgtcatcgccggcgtgacgccggtgaccaaccctacttccaccaccatgttcaagtccctgatatcaattaaaacaagaaatccaatcgtgtttgctttccatccatccgcccaaaaatgcagccgcgaagcggcgagaatccttcgggacgcagccgtcaaagcaggagcacccgacaactgcatccaatggatcgagacgccttctctggatgcaacgcaagccctaatgacccacccgaacgtttccctgatcctcgcaacaggaggcgcaggcatggtgaaatccgcttacagctccggaaaaccggcccttggcgtcggacctggaaacgttccgtgctacatcgagaagtctgccaacctgaagcaagccgtcaatgatctgatcttatccaaaacatttgacaacggcatgatttgcgcatcagagcaggccgtcatcatagacaaaggcatctactcagacgtcaaagccgaaatgacaagaaacaactgctatttcttaaataaaaccgaaaaatcaaaggtcgaaaaattggtcatcaatgaaaatacttgcgcggtaaacgctgatatcgtcggcatgccggcattcaaaattgctgaaatggccggtatcaaagtgccgcaagatacaaaaatcctcatcgccgaattagaaggtgtaggtccggatgacccgctgtccagagaaaaactgagccctgttttagcgtgctacaaagtcagcgggcttgaagaaggattaaaacgcgccgaagagatgctggcgttcgggggaaccggccactcggcggtgattcatacgaacgatcaagaagccgttaaagaattcggcttaaggatgaaggccggccggatcattgtcaatgcaccgtcgtcacaaggagcgatcggcgacatttacaacgcctatatgccttctttaacgctcggctgcggcacatatggcgggaactccgtctcgtcaaacgtaggggccgttcatttaatcaacacgaaaaaagtggcgaaaaggaatgtcaatatgcagtggtttaaagtgcctccaaaaatctattttgaaaaacacgcaacccaatatttagcgaaaatgcctgacatctcaaaagcgtttattgtgactgatccgggaatggtgaaactcggatatgtagaccgcgcccttcactacttaagaaggcgcccggattacgttcattgcgaaattttttctgatgtcgagcctgatccttcaatcgaaacggtgatgaacggcgtcgacatgatggccaaattccagccggatgtcatcatcgccctcggcggaggttcggcaatggatgccgcaaaaggaatgtggatgttctacgagcaccctgatgctgaattctttggcttaaagcaaaaatttctggacatccgcaagcgcatcgtcaaatacccgaaactgggaggaaaagcaaaattcgtcgcaatcccgacgacatcaggcacaggttctgaagtcacttcattctctgtcattacagacaaagaaacgaatacaaagtacccgctggccgattatgaattaacaccggatgtcgcgatcattgacccgcaatttgtcatgaccgtgccgaaacatatcacggccgacacaggaatggacgtattgacacacgcaattgaatcatacgtatcgtgcatggccaacgactatactgacggcttggccatgaaggccatccagctgatcttcgaatatctgccaagagcatacaaaaacggcagcgacgagctggcccgcgaaaaagtgcataatgcatcaacgattgccggaatggcattttccaatgccttcctcggcatcaaccacagcttagcccataagcttggcgccgagtttcagatcgctcatggacgggcaaacgccatccttctgccgcacgtgatccgctataatgcagcgaagccgaaaaagttcacggcatttcctaaatacagccacttcatagccgaccagcgctacgcggagattgccagaacgctcggcctgcctgcaaaaacaactgcagaaggtgttgaaagcctcatccaggagatcatctcgcttgccaaagagcttaaaattccgatgagcattaaacaaaacggcgtggatgccgccgcattcgaaagcaaagtagatctcatggccgagcgcgcctttgaagatcagtgcacgacagccaatcctaagctgccgctcgtttcagagctggctgagatttaccgttccgcgtataaaggagtttag

SEQ ID NO: 4118 - DNA, 564 bp, Bacillus licheniformis
atgtctctaatcggaaaagaagtacaaccattcgcagcaaaagcttacaaaaacggtgagtttatcgatgttacacacgaagatctgaaaggccaatggagcattttctgcttctatccagcggatttctcatttgtttgcccgactgagcttgaagaccttcaaaaccactacgaagctctaaaagaactaggtgtcgaagtatactctgtttctacagatactcacttcgtacataaaggatggcatgacagctctgagaaaatcggcaaaatcacttacgcgatgatcggcgacccatctcaaacgatctcccgcaattttgaagtgctgaacgaagaagaaggtcttgctgaccgcggaacattcatcatcgatccggacggcgtcatccaagctgttgaaatcaacgcaggcggtatcggccgtgatgcgagcatcctgatcaacaaagtaaaagcggctcaatacgtacgccaaaacccaggcgaagtttgcccggctaaatgggaagaaggttctgaaacactgacaccaagccttgacctagtaggcaaaatctaa

SEQ ID NO: 4119 - DNA, 1530 bp, Bacillus licheniformis
ttggtacttgaagcaaatatcaaagcacaattaaaccaatacatgcagatgattgaaaatgacatcgtccttaaagtcagtgcaggcgatgacagtgtctctaaggatatgctggctcttgtagaagagctggcttccatgtcatcaaaaatcactgttgaaaaggcgcagctcgacagaacgccaagcttcagcgtcaatcgtgccgaagaagatacaggcgtgacattcgccggggttccgctcggtcacgaattcacatctttggtgctggcactcttgcaagtaagcggcagaccgccgaaagtcgatcaaaaaatcatcgatcaaatcaagaacatcagcggcgagtaccgcttcgaatcttatatcagcctcacatgccacaactgcccggatgttgtgcaggcattgaacatgatgagcgtgctcaacccgaacatctctcacacaatgatcgacggtgcggcatacaagtcagaagtcgaaagcaaaaacattatggctgtgccgaccgtatacttgaacggcgaatcctttggaagcggccgaatgacgcttgaagaaattcttgcgaagatgggcagcggcacagatgcgtctgagctttctgataaagaaccgttcgatgtactcgttgtcggaggcgggcctgccggcgccagcgcagcaatctatgcggcgcgcaaaggcatccgtacgggaatcgttgccgaacgcttcggcggccaagtccttgacacgatgagcatcgagaacttcatcagcgtgaagcgcaccgaagggcctaagcttgcggcaagccttgaagaacacgtgaaggattatgatatcgacgtcatgaacctgcaacgagcaaaaggcctcgagaaaaaagaccttttccatctagaactcgaaaacggcgctgttctgaagagcaaaaccgtcattctttcaactggcgcacgctggcgcaatatcggcgtacccggcgaacaagagttcaaaaacaaaggtgtcgcatactgccctcactgtgacggaccattgtttgaaggcaaagacgtcgccgtcatcggcggcggcaactccggcatcgaagcggcgattgaccttgcaggcatcgtcaaccatgtgactgttcttgagtttgcgccggagctgaaagcagacaaagttctgcaaaaacgtctctacagcctccccaacgtgactgtcgtgaaaaacgcccaaacaaaagaaatcacgggcgatgaaaacgtaaacggcattacttacgtagaccgtgaaacaggagaagaaaaacacgtcgagctccaaggcgtcttcgtccaaatcggtcttgtgccgaacacggaatggctgcctgaaaccgtcgaacgcaaccgcatcggcgaaatcgcagtcgacaaacgcggcgaaacaaccatccctggattgttcgctgccggcgactgcacagacagcccgtacaaccaaatcatcatttccatgggatccggagcaaacgctgctttaggcgcgtttgactacctgattcggaattaa

SEQ ID NO: 4120 - DNA, 630 bp, Bacillus licheniformis
atgtatttttcggcaaagaaaaaaataagaggctggaaaagactgaaacgaagaatagaatggtggaaatcagacaatattcaattgaatatggaatatttaagagatcatcatagagattacgttaaattatggatatcccctttttacgggcttcaaacagtgactcctccattatggtataaacgcttgcttttggaggcgatgatcgatgtctatcatgaatggcataagcaattgaaagctgaaaatgaagatttctacttgaaaatttggttgtatgagcctgattttatccgttcacaaattgtggctgcttataaagaagcgattgatttttacagtggttctttcgacaagcaagaagaaaaagaagcgttctctttgaaaatatacgaacctttagaacatgagctgaatgcatttgaatgggaacctcatattcataccgtgtattaccggctatctgatctggaggaggacctcgaactaggattgagaagcagcggcgatgtgctgcgcataaaagaaatgtcctattcaaaagataatgacggaaaagatgagtggtataaagtgagcgcaggaactgtatgggttggttcattaaaagaggtgccgcagaaataa

SEQ ID NO: 4121 - DNA, 1017 bp, Bacillus licheniformis
atggtgtttaaaaaaccaaaagttttcatagcagcggttatcttagctctcagcagctttgcggggacggctgcatatgcgcaatcaggctactttaatacgtataccgattatgtttccatgtctaagtcggggtatttcacggcgatgcaggggatgtgcgtcgaccgcaataacaatgtgatctacgctgcaaaattgaataacacgaatcacacgacgcagttattctctgtgaaaatgagcggtacggcaagcaatagaaccgttgcacttcttaaaaattcggataccaatactacgagctatgatttagggcacgccaatgacttggctgtcaaagcatctgcgggcgataaaagcgtcagcgtttatgtggcgccgatgtctgacggcactaagtatgccaataaaatcgtgaagctcagcgtcgatacaacgaaaaatacttataaagtggctaaaacatatgtgctgaattatcaaggttcgaatttgtcgattggcggtatcacatactcggttgggacggataaatttatcgtaagatcgggaaaaaggttctttattgggacattcaatgatacaaccggaaaattcgactatgaagcaacgtttaaattaaactattcgaaagctgttgtgaatcatcagacaatggatgtttcgcatttcattcagcaaggaatttccttttaccaggggacattgtatgtgccgcttacaaaaccggacagcaatggcaatgcttcaaatgtgagcattatattgacgtaccctttaaatatcaatgaaatgattaaagagcaaaaaacaaacccgattcaggacttttcgaaggaattgtttactcgcagcgatttatctttcagaattaccagcagtgcatacacgctttttgaaatagaggctgtcgattttgatgacgggacgctttactttaatacgaatcgcggaaaaagcgggacgcaaaacgatatgatcgcgacatttaatgattataattattataagtaa

SEQ ID NO: 4122 - DNA, 1597 bp, Bacillus licheniformis
atgaatgaacttgtgtttgaaaagagagaatttactcaagaccatgtgaatgttgtaaaagcaatgcatataaataactatccgattgtttatatcctttataacgagaaaaagaaaccgactgcatatattggacaaacggttcaagctgcacggcgtttgaaaaatcatatagatgatgaaaagcgaaagagtttgaatcgctttattttaatcggccatgagaaatttcatcagtctgcgacatacaatattgaataaatttaattaactattttatcgccgataaccgctaccagctgcaaaacgtaagccagaccaggtctagggaaatgcacaattactatcagaaacccttttataatgaaaatatctttcaagtcatttgggagaagctgagaaaagagaaaattgtgaacgattctctttaaaaccttaggaataaagacatttataagttatctccttataaagagctctcgcctcagcagcttgatattaaaaataagatccttgatttctgtaaagaacgtatacaaaaagaaggaaatcatgtcattgttattgaaggagatgccggcacaggtaaaagtgtcctgttaagctctctgtttaatacgattcaagatttggctaagagtgaagactcttttttgaaagaaacagataattacttgctggtaaatcacagcgaaatgctgaagacttataagagcatcgccaacagcttaccgaatttaaagaaaaagagtttcatgaagccgacaccatttattaatgagaagaccaagacgggagcaacagcggatatcgtattagtagatgaagctcacctgcttctgacaaaggaagattcctataaccatttccgctaccaaaaccagctgtatgaaatcattaagcgaagtaaaatcactgtggtgatctttgacccaaaacaagtcttaaagattaaaagttattggaacgaaagattgctcgaggaaatcattaatcagtatgatgcgaaaaccgtaaaactgacagaccaaatgagaatgaacgccaatccagaaacaatcaagtggattgacagctttgttgaaaagaaagttcttccctttccgactgaagactcctccttcgagcttaaaatatttgaagatgctgctgcgtttaaaacagctattgaacgcaaaaacagtgaagacggtctctcccggattgtctcgacctttgattatttacataaaaaagataaaaagacttacatcgttgatgaagaagggattaacatgccctggaacagcacccaagataaagtgacatgggcggaaaatccgaattctattaaagaagtcggctccatttataccgttcaagggtttgatttaaattacgtcggcgtcgttctcggcccttccgtaagctatgatgaagaaaaagacgaactggtaattgatacttccaaatacaaagatacaggggcattcgtgttacgtacagatttgtctccagaacagaatgaacaaattaaagaacaaatcatcctaaattcaataaatgtcctgatgaagcggggcatacaaggcctctatatttatgcgacagatcctaa

SEQ ID NO: 4123 - DNA, 897 bp, Bacillus licheniformis
atgagcaatgttgtaagcttgacgaatgtgacaaagacattccgccaaaaaacggcggttgatcagatagatttttcaattaaaaaaggagaaattgtagccattctagggccaaacggagccgggaaaacaacaacgatttcaatgatattggggctgttaaaaccgacggctggcaacatcacattattcgattccatgccgcatgaaaaacgggtgcgtgaaaaaatcggcacgatgctccaggaagtcagcgtcatgcctggtttgcgtgcaggtgaaatcatcgaactcatccggagctactatccaaagcctctatcctttcaaaagcttagaacgttgacaggtttgacagacaaggatttaaaaacacaggcagaaaagttgtccggcgggcaaaagcggcgtctaggctttgccttggcacttgccggcgatccagaactgatgatctttgacgaacccacggtcggcatggatatcacttcaagaaaccgcttttggcaaacggttcaatcgctcgcagagcaaggaaaaacgatcattttttctacacactacttacaggaagcagatgatgccgcgcaacgaatcttgctgtttaaagacggcaagatagtagctgatggaacgccgctccaaataaaatcaagaatatcgaagcattcggtttcatttatagttgatccggaacagtcactcgagaagctgtatcagcacccagaaaccgaacagatttttcgtaaaaacaaccgggtttacatcgacacggccaatacggacaaaatactggaactcattttctcagaaaagatcggcgcttatgatattcaaattgagcgcggaaatctcgaagaggcatttcgccagctgacaagcaaaggagacgagtaa

SEQ ID NO: 4124 - DNA, 516 bp, Bacillus licheniformis
atggttcaagaacgcacccaaggctggtcgacgttcatacgcgtaacgcctcttcccgaccacatttattttatcgctcaaatgtcggggcaaagcgtcattcatattctttcgatcacagtaatcttcttagccggcgccttgatcaacggcgtttctttatccccattggaatggttcctgtgcggattgtgggccctgcttggctcgctcccgtttctggcgatcgggacattgatcgggatgatgaaaaaagtggatacagcagccggaatcagcaatgtgctgtatatggggctcgccgtatgcggagggatgtggatgccgcttgaaattatgccaaaaatgatgcagaatatcggccattggctgccgtcctatcattatggcagcggcgcctgggaaatcgctcgaggtcaaatgccaaactggaaaaatattctcttcctattagcctattcaatcgttattatgctactatctaaatatataagaagaaaacaagaagcggtgtga

SEQ ID NO: 4125 - DNA, 1143 bp, Bacillus licheniformis
atgaaaaaaaacttcagcatgtttccgaaacggtacggcttttttccttatatctttttaatctatttactgctgcccatttcttatttgacaaatcagacctcgggaatcaaacagctgatcggttttggactcgtgctgcttttcttggtgacgtaccgccagcttttttttattccgccgcaaaaaaaattatttacttattggctggccatccagctttcaatcattttaatctacactgtattttatgatatcaacttagtatttttaggctttttttcagcgaactttatcggctattaccgggaaaaaaagacgttccggtgcggccttgccagcctggttgttgtattggtcgccccttttatctatcatctgctgaaagatccatccctgcttaatcggctcttttattttctgccctttcttgtgattatgctcatttcaccatacggcatccgctccatgaaccgccgcatggaactggaacaaaagcttgatgaagcaaatcagcatattaaggaactggtcaagcgcgaggagcgtgtacgaattgcccgcgatctgcacgatacacttggccatactctttcactgctcacattaaaaagccagcttgtccagcgcatcatcgccagcgcccccgaacgggcgcgaaaagaagcaagagaaatggaaaccacatcaagagcagccttaaaacaagtccgggaactcgtgtctgatatgaaaacggcaactattgcagaagagctcatccacatccagcaaatcctgcgggctgcagacatcacattcgaatacatgggaggttccgatttttcaaatatccctcctgtcacacaaaacattgtcagcatgtgtatacgcgaagccgccacaaatatcgtcaaacacagccgcgccacccattgcaccatttccatctctcaaacagatgataaaataagcattaccatcaaagacgacggaatggggatggatcagcaaaaaacaccatttggtaacggcttgcgcggaatgaaggaaagacttgcattaatcgacggcgctctcgacgtttcaacccatgacggcacagttttaagcatcgccgttccaaatgtaaagaaagctgaaggaaaggaagcaatccaatga

SEQ ID NO: 4126 - DNA, 603 bp, Bacillus licheniformis
atgattcgtttatttattgccgaagaccaaagaatgctgttaagcgcgctgggatccttgcttgatcttgaagaagacatggaagtgatcggccaggcgacaaacggcgaagaagcgctcaccgccattctgaagctagaaccggacgtctgcctcatggatatcgaaatgccggtcaaaagcggactggaagtggccgaagagctcgcaaagcaaggcgcaaaaacgaaaatcatcatcctaacgacgtttgcgcgtcccggctacttcgaacgcgccgtcaaaagcaatgtccacggctacctgctcaaggacggggaaatcgacgatctcgcagacgccatccgaaaatgcacggaaggcaaaagaacctttagtccggaacttaccttcaacgctgtccgcgaaacaaacccgctcaccgaacgcgaacaggacatcttgcgactggcatatatcggaaagacgacaaaagaaatttctgaggagcttttcttgtcgtcagggaccgtccggaattatatttctgagattatgcagaagctggatgcgaaaaaccggatggaagcggcaaggattgcggaggggaaaggatggatttga

SEQ ID NO: 4127 - DNA, 1989 bp, Bacillus licheniformis
ttggaggtccagcttgtgtataaacgtattatagtggctgtcgcgggcgcgttgtttgctctgcttgcgctactggcggcgattatcaccgacctatatgatcgagactttcctcaggcgattggtgccgagagcaggttaaaccttgatttcagcgaatcggggctttctattactgaagcgtttgcgaagctggagaagctcgatgcacgctggaatcttgggctggtcaaggttgcgccagaccttgcaagcgacggcgatggccaggtctacgtagcacttaacgatagagatctgcccgacgaatttacttggtttggcggcgatggtgcaggcaagattgtcggtaaggaccggcttgaaacctcctaccccgatgggttctatctcgtgaccggtgaaaaggctcacttgagcgagtttgaggacacgctgaaaagtgaaggcgtgaaggtcggtcgcggggatgcgtccatttttaaaagccttgaattcgttgtgcgagaaagaggatttgctgccgctgttcttgcagcatttgcgctgattgcggcgcttgcgttgttctggttgtcgttaagagcgcgtgggcgtgctcttcgggttctgggcgggtgcccgacctcgcggattcaggttcaggacctggccgggttcgggggggcgctgctggtttcggcggtggctgtagcactggttgcgtcttgctacgtaggtttgtttcatggctggatatatgtcggtaccttcctcaatgcgctgttcagtctgcaggtcgctgttattaccgtatccctgttggctacgctgatcatgtcagcttccgcatggcctagcgctaccatgatcgccaccagacaacctgctgttaaaagcttgcgttcagctgccatcgtgatccaggcgttaacgttcctcctggtggtagctgcggctggacctgcttggtccgcatacaaacattcctcagctatagctgctgaaatggctcagtggaagaaactcgcagatcaagttgcgattgtgtttgcgacagacgttgacgagatgaaccacatggagccgctgattggtaaactggtaaaggatgcggaatcgcttgataaggtagctttttcctacacatatactcaagaaatgccaatgccagccgattttggagagtactcggccatctcttacgtgaaccagcgttggcttgatatggtgaccatggatgcaccacagcctgctgttacaaaggtgccttatcatagcattccaaaagggcttgtcaaaatgattcgagaagaggccgagcttttgtcgaggaaagagctttccgatgagcagttcggtaagttcaagttcttgcggccgatcgacggattccggttgccggtagcccaaggaggaggaggggaaagacttcactttgcggacgatgtcctagttgttgtcgtgccctcgctctacgatacttataacgattctgctttgacttccatggtctcaggtagcaacatcgtattcactggtgtaactgctacgcaggaattgttagggaaacacggccttgacgtgaaggcactgcgtgatcgagatatcaacggtgaactgaaagttgtctatgttgccgaagaggggattctccgcgcgcagttcgcagcgtacgttgtatggttgttgaatcttgcgctgattgcattagttattgctttcactgtcgctgctgcgattagtgcattgataaccgcgctgctgcaggcgaagcgtgactttccgctgcgggtggcaggccagtcatgggtacggattctccggagccgtgtagccaaagaaatgcttgttggggtcggccttgtgggcgttgttgttttgctccaaaggcctgatgagataggggctgtactagtggccgcggtgtatgggttgcttgttgtgccgctgagtcatctgtttgctgtacgttggtgttttgatagagccagcaaacggcgaatttga

SEQ ID NO: 4128 - DNA, 357 bp, Bacillus licheniformis
atgaaatcaaccacgaagatcattatcggtgtcgtcataggattattgcttgcagttggaacaattgcattcctaaacggatggatcacagtgtcaagagacactcatccgccgtgcgatcagctgccgaacgtaacagaggccaatgcagcgctttccagacatcaagacctcgtcgaggagattaaagctttgggtgatgacattacggtcgaagtaggaaagccgtgtcctgatgacgagaaccgagggctggtcatggttagctatggttcaagatccgagcatgacgcaatctccgacctgctcagccgccgtgacgggtttggggtcccagtgcacctggtgaagcgctaa

SEQ ID NO: 4129 - DNA, 693 bp, Bacillus licheniformis
ttgattgaagcacagggcatttcagtagcaattggtgggcggaccgtgcttgatggtgagaccgttcagtgcccgccaggggtcatgacagccctcgttggtccaagcggatgtggaaagactacacttttgcactgcctcgggctattgctcccggttaatcagggacgcatcttgatagacggacacgatgtcacaagctacggtactgcggcgcggcggcggttttggcgtgatcatgcggcgttcattcttcaggattacggcattatggatgaggagtcggtggcattcaatgtcaccatgcaggcgagcatccttgggcggcgtgtcacgggaaaccaagagcggttggcgcaggtgctcgagcagacgggtctccagggtcgagaaggcgagttggctagccaccttagtgggggcgagaagcagcgactcgcactggctcgtgccatctacaaggacgctgcattcttgtttgtcgatgagccgaccgcctcgcttgactcaaccaatcggcgaaaggttatcgatctgtttgcggacttcgctgcgcgtggccgcacggttattgtgtctacgcacgactctgagatgatcaacgcgtgtggtgctcggcataaggtcggttccagcagttcgtcaaaaccattgtcgaccaacgatcccggcaacttaggaggtaactcatga

SEQ ID NO: 4130 - DNA, 381 bp, Bacillus licheniformis
atgaaaaatcatttgtatgagaaaaaaaagaggaaacctttgactcggacaattaaagcgacgctcgccgtgttgacaatgtccatcgctttggtgggaggcgctacggtgccttcatttgcatgggtgaatccgggttatcactaccagtacccatcggaaggtggtacatggaggtatggattcgtaaacgccgggctccgttcagagtacaaccacccgacaaaggtccacggctcgacagtgcaaaagctcatcgatggaaaagtggataaaacgaatagaagtattgatacggctgcgggccgctactctaatgcctatgtcggagccataaactcacctggtcttaagggtcgttactactatcgcaccaactaa

SEQ ID NO: 4131 - DNA, 159 bp, Bacillus licheniformis
atggtggaagaagtcaaagaagcggatgtcaaagatgaaggactgctctctcttttcccgaagacgatccgccgcaaaattcaatatcgtagaaatcggcttgcaaaagccaacgcggcattacaagaactggaagaacgcacacctgaagaaaaatag

SEQ ID NO: 4132 - DNA, 129 bp, Bacillus licheniformis
atgatttgggacagtgtcctggataatatagagacaaaacaggtgaaacgccaaacaactactgcggatgccaaacactatagtcctgaaaacatcctgccaaagaaacaaatcaaacaagatacctaa

SEQ ID NO: 4133 - DNA, 987 bp, Bacillus licheniformis
atgactttaatagaacgttggagtaaggaatatctcgaaatggatgcaagctatgaaaatcatattaataaatttgtaaattttattaagaaaataaataaagccgataagccaacaaaaatcaatattaatgatgtagaagattgtataggtcattacaatgaattgggacaaattaatacggtaagttccatggaaaatcatttggaaagtattaaatcattttataaatttcttgttagtaaagcgtggtcaaccgatatatttgttgaattgtatgattatcagggctataagaaatatttaacagataagtttaacttagaggaaacaaaagaaagggaattttttgatcaggatgttataaaaaaaattattagttgtttagatgattattttgattcaagagttttagcggacttatcaggtcaaaaaagaaaacggtatatgagctatgttttattgaggctatttattaaacttaccttaattgtacctgctaaaagggctattatatgtaatataaaaaaggcggatttttcaacagactatagaacaattactataaacgatgtgcagataaatataccaaatggtttaagaaaagagatcattataaatattaagttggtggaaaagctaaaggataaaaaaatggataattctgaccgattattttatttcttgaatgaaagctcattccgaccagaagatttgaattcatggttttgtaatttattaagggaatttaatattattgatatctcagaagataaatctacttatcctgttgaaaccattagaaactctgtaattgtggaattaattttaaaaggattcgatttggctcttatctctaaagtgagtggagtttctatttcaaccttagaaaatagatattacaaggttaaatcttatgaagctgaggaattaaataaattaataaatgaaggaatagcagggattccatattatagctatatataa

SEQ ID NO: 4134 - DNA, 1353 bp, Bacillus licheniformis
atgttaggagaaaagtttgaggaatttgtcgatggattacaaatagcatcaatagaggaagaaacgaagagggtaaaggaaattaccaaaaggctaaataaatcatttcgagacttagataatgaggaaatagaaaacagtcatatagtaggttcattaggaagggatacagcaataaaaacattcagcgatgttgacatgctttatgtactaccaaaggaactaaaaaatcaatacgatgaatacgagggaaatggtcaatcgaaactattgcagaaggttaaacaggaaattaagaaacgatacccaaaaacaatagttagaggcgatggacaagttgttgtcgtaagttttgagagtataaacaaaacagttgaagtatgtccatgctttgagagaacggatggggcatatgattatcccgattcaaataatgggggttcttggaagaaaactgaccccatgccagaaattgatgagagtataaaagttatagacgagacgaactcgaattataaatatgtttgtaatatagttagagcttggaagaataataaggggtttaaatttggtgggttattaatagatacattagtttataatttcttcaatgaaaatgaaaactataaagattcgacttttgatgattacctttctttgttaaaggatcttttctattacttgaaaactcgaaataaggatcaaaagtattggtacgctttgggtagtaatcaaaaggtttataataaaggtggagcgttcgttaatcaagctaaaaaggcatatgaaaaaatcaaagataagacagaagatagcgaagacttatatgaaaaattacaggacatttttggaaaggcgtttcctatacctgaagaaatacaagagagtaatgtgattgaaaagagtgcattatttggtaggagtgttcgacaaacagaagaatttattgaacataagtttgatgttgacattcgttatcatctaaaaattgactgtatagtaaaacaagatggatttagaaataagtttctaagaaacatcttacgtgataagttaccgttaaaggcgaataagagcttagaatttttcataacagaaaatgaattcgaaacattgtctaaagatgatgaggataatctttattatgaagtgtattggaaagttcttaatcgtggagaggaagcaatcagaagagactgtataagaggacaaattgtgagagacaagggtacacacaagaaatttgagtctactaactttaaaggcgaacattacgtagaatgctatattgtatataaaaatgtttgcgttgctaaagacaggattagtgttcctatatctacaattaattga

SEQ ID NO: 4135 - DNA, 585 bp, Bacillus licheniformis
ttggaaagaaatttgtttttacgacaacttgcagagaatggatataacgtaatatatggagctaaaaagcatttttcaacctatgatacagttgtaaaaatgccagggagaatagccttcattacacttgccattggtatttggcaaatatataaaccaagtttcccgtataattcagaaatttccttacttttaataatcgcaagcatcattgctttaaccattagtcaatacaacagtgaaaaagatagatatagagaagttggaaataggttaatacagattcataatgaacttcgagaaatatattatcaggctaaaagttcagaacaagagaactttagcaatgaatcgaacgaagcaatacgaatgaatgagttattgaatgagttctatcaaataagcatctcaaaacagatatttctgagtgactgggttgctcattataagcttttttttcaaagtcagtatgaatggatagatgagcaaaaaaaattcacttggaaggacaaaattcccatttccttcagaatagcagtaattggtttcattgcgtttatcatactattaatcattgttttatag

SEQ ID NO: 4136 - DNA, 495 bp, Bacillus licheniformis
atgaacaaggacaaattccaaacaacagatagcaaaagtcgtgtaaccttcgtaaatgagttattaaaaagagaagattttgatttacaaaaagtagcggatgttcttgaaatgaactattctacctttactaaactgatgcaagaagacgattatgtttatattaaacgggaaaaccagtattacaaatttgttcgtgacgaaagccagatatttactatttctgaccaaactgattctgagatggattatattaaagcgaatttttcccttctaaagagcataatagaacgatataaacacaaagatgacttcattattgataagcgtattttccgatctacctctaaaacctccagtaaaaacttccgtatgccagacgatctctaccaaaactttgttgctacttgtgaaaacgagttcccccacttgaaaatccaagatattattgctcaacttcttctcgactttacagataaatattccgacaagtaa

SEQ ID NO: 4137 - DNA, 915 bp, Bacillus licheniformis
atgattcaaggtaaaagttacattagatctattgagaaatatattaagttagttgatggtgtttttcgattaggagtgaaaattacgaatgaaaacaaagagaaaatagaaaagataggttttcctgctttcgaagctggacaagcaatgtttccgcctatagttggcaggtttactcgtttcaatgtagaaggtaaggagattataagaagagatcttcccaaagaaactatctatgtttctatgtattccacacgtaaggagttcagagggagagatcaaacggaggaagtgacagatttcgttgatattccccgtcaagtttataaaaaagagattataccaggaacaggatttgaaattgtaattgaagcaaaaggtgatgatttatttttattgataaatgaaacttttaataaagaaacagattcggagatagctacagttggagcaaatattattttagagttagtaggatattgtgaagttttctcagaacagttagatacctattacaaaccttcatatttaaagcgatacaattggatctttttggagagtaaagaattgccatgggaagaacgaaaggaacgttttaaagaaatagttgaatcaagtaaaaaatcaaaacagatggtaatttgggaaagacttgaaacaatcgttcaatataagcctgattttgaagcaattggtcagaatggcttttcaggttatgttgtattcggatttaaggataaggaattatatgtttttgaaagtgcaaatgtaggcaacgctacttatattgttaaaggggattgggaaagcgtgtctaaaatgagtaaagcggaaattatcaaaaacaatcttcatgaatggcggcttattcatcgaaatgattggaaaggaaaagtaaagaaggtacttggataa

SEQ ID NO: 4138 - DNA, 726 bp, Bacillus licheniformis
atggaaagacatcaaatccagtatggcaacaaatgtattgattttatgcttgaacgtaaaaacgttaagaatgtgaatttaaacattaagcctgatcggactattcaagtatcagcaaatgacaaagtaccgattgattttatttatgattttgtgaaaagtaaaggtgcttggattgtaaagaatgtgaaaacattcgaagacgtattacctcataaacagagtgagcgagagtatgtaagtggggagtcttttcgttatttagggaagcaataccgtttgcgtgtcgaaaaaacagaagacgaagaaatggtaaagtattttagagggtttatttacttatatgttcaaaatccacaaaactataagcggaaagagaagttgatggatggttggtatcgggaaaaagctctgaaaatttttcaagagtccctcgacaaaatgagcttatatatgcagaaatatggtgtagaaaagccctctttagatttacgattgatgaaagcacgatggggttcagcattagtagataaaaatacaatacttttgaatacggaactaattaaagctcccaaacattgcatcgactacgttgttctgcatgagctgattcattttaaatacaacgaccacagcgataacttttataaaatgttatatactcttatgcccgattgggaaaaacggaaaacaatactcgatgaagagattgtccaagaactttaa

SEQ ID NO: 4139 - DNA, 3108 bp, Bacillus licheniformis
atgtcgattccgcaaagttatgatgaacgttacattagtcaacagcctgcgatcgaggtgttgcaaggcttaggatatgagtacatagaggctgaacgagctgaggcgatgcgtgagaatctctatagcgttttgctgaaaacggtattggaaaataaattgaaggagttaaattcctatcagtataaaggtgttacgtacaagttcagtgaagcgaacatccaacaagcgatgcgagatttggatgagccactcacaaacggacttgtaaaggcaaatgaaagcatttatgaaacgttgatgttaggaagaacttatacggaattacttccagacggctcgaaaaagtcatttaccattcaatatattgattgggagaatgttgaaaataatgtttttcacattgtagaggaattttctgttgaacgtgtagacggcaggggtacagttcgtccagacattgtgttgtttgtaaatggcattccgtttgcggttattgagtgtaaaaaggcttcgatttccatggaacaagggattagtcaaatgattcgaaatcaaaaaaatgactatgttccccaactgtttaagtttgtacagatggtgatggcaacaaataaaaacgaaacaaaatatgcgacatgtggaacaccgaagaagttctggtcagtgtggaaagaagagcatgaggaatggttagatcattggttacatcaaaccgttgaaaaccgattgccaacgatgcaagacaaaaacatcatttccttattccaccctgaacgactgcttgaattgacatgtttctttacactgtttgataaagatgtaaaaaaggtgacacgttatcagcaatattttgcgataaaagagatattaacaacaattcaagagcgggatgaaaatgggaatcgacagagcggggttatctggcacacgcaaggtagtgggaaatcgctcacaatggtgatgcttgcccgttacattttatcagagttaaatgactaccatccaaaaattattgttgtaacagacagggtagaactggataagcaaattcacaaaacgtttaatcacacgagattaaaagcaagtcgagcgacatctggaagccatttagtttcactgattaaagatgggaatgctgatatcgtcacgacattagtgcataaattcgatacggcatcaacaaaacaacagccaattgaatcaagagacatctttgtacttgttgatgaatcgcacagaagccaatatggagaattgcacattaaaatgagaaaagtgttcccaaatgcctgctacttaggctttacaggaacacctctcatgaaaaaagaaaaaagcacgatgatcaaatttggaaagctcattcataaatacacaattgccgatggagtaaaagatcgagcgatcgttccgctgttgtacgaagggaaaatggttgatcaaacggttaataaaacagcgattgataaccgactttcgatgatcactcgtcatttgaacgataagcaaaaagatgaagtgatgaaaaaatggagtcattttgaacgaattgcttcttctgaccaacgcattagtatggttgcatttgatattaatgatcatttttatcgcaattacaagacacaaggttctcagtttaaagccatgcttgcgactaatagcaagatggaagcgattcgttatttagaagcctttgaagaactgggtgatttaaactgtgcagtcgttatctctccaccagaccaacgagaaggtcatgatgcgatagatgaagaatcgaatgataagatccaacgtttttggcaacgaatgatgaatcggtatgggacagcagaagactatgaagatgccattaaagatgagtttattcatggtgatgatattgatttacttattgtagtagacaaactactgacaggttttgatgctccaagggcttcgattttatatattgataaaccaatgaaagaacatacgctcttacaagcaatcgccagggtaaatagactatacgaaggaaaagactacggacttattattgattatcgtggattgttatcaaaattagatgaagctctgcaaatgtattcaggtgcagggttagagaattttgatccgaaagatctgcaaggagccattcatgatgtcattagcgtagtcggttcacttcgtcagcatcattctgacttactgcaactgttctcatcaattaaaaataagcaagatgtcgaagagtatgaagtattgttagaagatgaagagaagagagaatcgttttatgatacattaagtcaattcggtcgtaaccttgggattgcattggaatccgaacgaatctataatgcactacagccagaagaacttgccacgtataaaaaggacttgaagtttttccaagagctaagaaaaagtgtaaaattgcgttattcggatacaattgaccataaagagtatgaggcgaaaatgcaaaagctgatggatcaatatatctcagcagagcaagtcatccgtattacaaacccagtcgatattctaaatgaaaaggcctttgaagaagagttggagcgtttagaatcgaaacgagcaaaagcggatgccattcggacacgattaacgaagagtgtccatgcgaaatgggatgaaaaccctgcttactataagaagttttctgaacggattcaagaggcgattcaggaatataaggataagcggatttctgaagcagaatacttgaacaagatgaaagatattatgaacgattacagaaacggtgaatcaaaagaagattatccgactgtcatcaaagaaaataaagatgcacaggcgttttacggtgtgacgaaagacattttaagtgaaacgaaagaagaacgtgcaagttacggtgaggatttgcttggagaattagccttgaagatggatgaaatcatcaaacagcatcagaaggtcgattggcataacaaccttcaaatccataatcgcattgcacaagatttggatgatctcttatatgacttttccaaagaacataacgttgagttagattatgacacgattgataaattaattgaacaaataaaaacggtagctatcagacgttattag

SEQ ID NO: 4140 - DNA, 1164 bp, Bacillus licheniformis
atggaagcatttaagcaatacaaatgggaaaatggaaatcttagtgacattgctgacattactatgggccagtcgccaccaggtaattcctataatgatatcaaggatggaatcggtttaatcaatggaccaacagaatttacgaataaatacccagttgtaaaacaatggacatctaaacctacaaaactttgtaaagctggggatatattattgtgtgtaagaggaagttcaacaggacggatgaatatagctgatgatgaatattgcattggtcgaggagtagcttctattagagctaaaaaagataaagctgaaacaagttttatttattacacattaaattataaagttaatcagttattacaaaagactgcgggttctactttcccaaatcttagtagtaatgaaataaaagatatgattgtcggtattccattatttgcagaacaacaaaaaatcgcctccatcctctctacctgggataaggcaattgagctaaaagaaaagctaatcgagcagaagaaagagcagaaaaaagggttaatgcagaagttgctgactggtaaagtgagattgcctgggtttagtgacaaatgggaaaagaaaaaaatcggtgaactattagaagaaagcaaggtaattgcaaaaaatccgcaattagataaaaggattactgtgcgattaaatttaaaaggtgtttgtaaaagagaaatatctacggtggaaaaagagggagcaactacacaatatatcagaaaagaaggccaatttatttatgggaaacagaatcttcataagggggcatttggattgattccaaaagagttagatggattccagtcttcatctgacataccttgttttgattttaaagaaggtgtagatggtctctggttttattattatttttcaagagaaagcttctatactaatttagaaaatatctcaagtggtacaggttctaaacggatccaacctaaggaattatacaagttaacaattaaactcccgtcacttagagaacaacaaagacagtcaaaaattttagaatgtagtgataaagaaatttatttgttagagaaagaattagagacttatagaaaacaaaaacaaggtcttatgcaacttcttctaacagggaaagtccgagtgaaggtataa

SEQ ID NO: 4141 - DNA, 1005 bp, Bacillus licheniformis
gtgaataatgaatctaattttctaatgtaccaaaccgaaaatggcgatacgaaaattcaagtccgtttagaaggtgaaaccgtctggatgacgcaaaaggcaatggcagagctgtttcaaaagggtgttccaacaataaatgagcatattaaaaatatatatgctgaaggtgagttaacagaggaggcaactattcggaaaaaccgaatagttcaagttgagggttctcgtgaagttgaacgtgaagtgaccttttacaaccttgaagttatcattgcagtcggctatcgtgttcgatctcatcgtggtacacaattccgtcaatgggcaacagagcgtttaaatgaatacatggtaaaaggttttacgatggatgatgaacgcttaaaagaaatgcggaatattggggcagattattttgatgaattattggaacgtattcgtgatattcgtgcttccgaaagacgtttttattacaaaataacagatatctatgctacatctattgattacgatccgaatacaccaattgcaagagaattctttgcaaccgttcaaaataaactccattttgcaatccatggacatactgcttcggaactgataatgaaacgagcggatgcaacaaagccaaacatgggcttaacgagttggaaaggtgacaaagtgcgtaaacatgatgtcactgtggcgaaaaattatttaacacaagaagaactcagcgatttaaaccgtatcgtgacaatgtatttagactatgcagaaacacaagcgaaaaagaaaaagccgatgtacatgaaggattgggcagaaaaattagatgcatttttagagtttaatgaacatgaaatattaactaacgctgggaaaattaaagccaaagtagcggaacaatttgcaaacgaacaatatgaagtgtttcatcaacaacgattagcagaaccgaagaaagatgattttgatcaatttttggaacaaaggaagcagttagacagtgaaaaatag

SEQ ID NO: 4142 - DNA, 495 bp, Bacillus licheniformis
atgttagcaaagggggatttttattatggggcatttttatcacagttggtaaatagcggatttgccccagctatttttgaaaatagcgaaaaaagacgtatttataaattgtcaactaattatggtgactataaagtttatacgaagtatgtatcgaagcaaagtaataaaggtcaaaacagaatgtggcattttccattcaatttggatgaagtaaacaacattcaacaagaccaatctatcaatatgtttgcttttatttgcggggttgaagatttagttaatagtgagatagtgattttaagtagagaggaatttaatcagtgtatcggtgtaggttttaaaacagaaaatcgacgtgtgtcggttaaatctgaaaaaggtgcatggaaccatttagtttatggaactggtatagaactaaaagaaactccacttaaggttattaaaaacttgaataagagattaagtgaattttcaatggtctctacttga

SEQ ID NO: 4143 - DNA, 1530 bp, Bacillus licheniformis
atgagtgaaaaagtaacaaaagaccaaattaacagtgttttatggcaagcggccgacacatttagaggaaaggtcgattccagtacatacaaggattatatactgacaatgctgttcatcaagtatttaagtgatgcttataaagagcatttagaagagtatacgaagcgttataatggtgatgagcaacgtattcaacgtgcgttatcaagggaacgttttgtgttagatgaacagtctacatttgattatttgtatagcaaacggaatgatgcagaaattggtgaaattattaataaagcattggaacgtctggaaaacgaaaacacaggtaagttgagaggtgtcttccgtaacattgacttcaacagtgaagcgattcttgggaaggcaaaagaacgaaatgcaatgctccgttctttattagaggattttaataaactgacattaaagccttctgttgtaggaagtgaagatgtcatcggtgatgcttatcaatacatgatcgaacgttttgcatctgatgcgggtaagaagggcggagaattttacacgccttctatggcttcggaactgttagcacgtcttgttaaaccacaggaaaatgatagggtgtatgatccgacgtgtggatcaggatcacttcttattcgtgtagcaaatcaagtaccaaataagaaagtagctatttatggacaagaaagaaacggagccacgcactcattagcattaatgaatatgtatttgcatggtatagacgatgcgaaaattgaatggggcgatacgttagcaaatccacttcacttagaagatggaaagctaatgaagttccaagcaattgtagcgaatccaccattctctcttgataagtgggcgatgggctttgcgggagaaggaacaaacgacagcaagtttaaaatggaagcaagtttagatccacatagacgttttgagtggggtgttccaccaagttcaaaaggagattatgctttcgttcaacacatgctttattcattagcggaaaacggtcgaatggcaacgattcttccacatggtgttcttttccgaggggcaagcgaaggcaaaattcgtcaacaaatcattgagatgaacttactggatgcggtgattggcttaccagaaggtctgttttatggaactggaatccctgcttgtatccttgtgttcaagaaaaatcgtactcgtaaagatgttctttttattgatgcatctgccgaagggaactacgaaaaagggaaaaatcaaaatcagctaagagaacaagacatcgctaaaattgttgacacatatgaaaagcgtgaaacgattgataaatactcctatgttgccactttagatgaaataaaggaaaacgactataacctaaacattcctcggtacgttgacacatttgaagaagaagagccagtggatatgcatgcggtgaaagagaatatcgcaaacatcaaacaagagctacaagaagtggaagcggagatggagaaatatttgaaggaattagggctgtaa

SEQ ID NO: 4144 - DNA, 597 bp, Bacillus licheniformis
atgaatcttggagatattgcagacattcgaacaggacttgttttaacgagaaagaaagtagaagtggggaacgaagtgaaagccacatataacttaattaccttaaaaaatattactgaagagggagtctttaacgatgaaccattcgaagtgttccatagcaatgacctgttaaataatcaacactttacggaagcaggcgatgtactaattcgattaaattatcctcatacgtctgtctatatagatgaaacaaaatcaggcttattagtcccatcttactttgccattattaaagtggatcagtctaaatttatatctgaatatgtagcatggtacttaaatacagacagtgttaaaaaagaattggaacgttcgcaggctggaactcgtataccaagtacaaataaatcggcattaaattcgattccgattgaagatatacctattttcaagcaacaagctgttattaaactgtggaggttacatcagcaagaaaaaacactctacaatagattaattgaagaaaaggaaaaatggtttaacgccatcacaaagcaaattgtgcaaggtgaaataagggaggaattagaatga

SEQ ID NO: 4145 - DNA, 564 bp, Bacillus licheniformis
atgttcgaagtattgcaaaagagattgccgtactttttaaactttcattatcggaaaaaaacgaacctccacgatcacgtgcttacagttggatctggtcgaagcaacatctcttatcgttgttcggcaaataacgcaaaatcactggcatttgttgaactaaatttcgattcctcaagaggaaaagaatatgagagatttaaaaatatggagcaaacaattcgacaaaaaatacactctcaagtcatatttaaagatcggaaagtcggtgtttattttcaaccattgcaaacctatgaagaaacatttgaacaaatcgctgagatatttgaacaattcattttgttctttagtccttacctatatggtggaaaagatataaatgttataagtgaacaggaagaaaaaggtacaaaaggcattcaatctgcaattttaacaagattggattattcgcctaatagattggtggaggactttttggaagaagaaccatgggagatagaagacagtcatcgaatacggcaagaaggaatggcagatttctacctgtataacggctaa

SEQ ID NO: 4146 - DNA, 174 bp, Bacillus licheniformis
atgaaagaatcccctactttaaatctccatgaagaaattgaaaaacaattattaattggagcagagctggaaaaatacaatgcccgaaaatttcttaacttactgtccgatatgattgtcaaatatgaatctactatttacgacaaatttaaggaaagcagattaggagcgtga

SEQ ID NO: 4147 - DNA, 1514 bp, Bacillus licheniformis
atgcgagctgttggttacgttcgagtaagtaccgataaacaattagacaatacttctattggaaaacaaagagaggaaattgaaaaatactgcaaaaataatgatatttccctcgttcacatctttgatgagggggcgaaatcggctgaatcatttaaaaatcgtactgaatttaaagagttgtactcatttgttttagataaaaaaacaaaatagattacgttgttgtttatgattctgatcgtatatcgagggataatttagaatccctttatatttataagcgattaacacaggcgggaataaaccttatctgtatagctgacaatattgatacaagagatccaagagcgaaaattctttaccaaatcatgtcattagttgctgaattagaaagagatatgattattttccgaacaaactctggcatggaaaaaagagcttctgaaggacattttaatggaggcgtaatttatggatatgcatcaaagaataagaaacttaaaattgtgcctgaagaagcaaaagtcataaattatatttttgagaagtatgcgataaatcagtggggttatagaaaaatagcgtcacacctaaatactttaggtatcactactaaaaaaaataatttatggtcaataactgccgtaaaaacgatactaagtaaccccatatatattggcaaagtaaagtggcggaatgaactgagagatggaaaacatgctcccatcatagatatagaattatgggagaaaacacagcaagtaatggatctaaacagttatgtgcaagagaagttgcatcctggaagcttccccttatcaggtttgttaaaatgtccagaatgtggttcagccatggtacaaggaaatagcagtccaaaatacaaatactaccaattctccagaaataagaacagtggtagtaaggcatgttcctcaaaccttgtaaaaaaggattatgctgagcaacatgtatttgatcaattattttgtgatttgcaaaaatacaatgttaaagagccattgattaaaatgattcactcatacgccatgagtgaaattgagccattggaaacaactatcaagacgtatgaagttgagttagaggaattaaaaacgaagagaaaagaacttataaattggaggctaaaagatattatttcagaagagattttaaaagaggaaatggaagatttacgagaggaagaaaaattaataataactcgaattgaaaaattacagcacctcattaaactcagagataaaacctttttaaccaatatcatttcaacttcactacacgatctaaagaactttttcaatattatcgaagatgatgacaaaaaggaattacttcgttctctcattgaagagattcacgtaaatccaggaaaaactactaaggatagaacgatcaaagaagtgatttataagtttgatttaaaatatttgaaatcaattgaactaagagaaggggaacatcttttctcttttttgtgtttcatattataa

SEQ ID NO: 4148 - DNA, 1245 bp, Bacillus licheniformis
atgcacgaaataaaacgtgtcgcaatttactgtagagtttctaccgaagagcaggcaacggaaggatacagcatatctgcccaattacaaactttacgtcaatatactcagttatatggttgggagattgcagaggaatatgtagatgagggaataagtggaaagaacattagcggtcgccctgcaatgcaaaaacttatttcagatgttgaaaaggataaatttcaagctgttcttgtttggaagatctcacgcctatcacgaaatatgttagatactctcactctattagacaaattcgaagattatggagtaaagttcatctcttactctgaaaactttgatacaggcagtccaattggtcgtttagttgttcaactaatggcttccattgcagaaatggagcgtaatacgttatctgagaacgttaagctcggaatgaaacagagagcattagaaggttcatggaatggaggcgttgtatttggctacgatacaattgaaaaagagcttgtgatcaacaaaaaggaagctgagattgtacaacaaatctatcaactatatgccaatggtaaaggcttaaagtcaatcgcaaactacttaaataaagcaggttacagaactaaacggaattgttatttttcgataaacggtgtagctcaaatcttagacaatgttatctataacgggaagatcagttggttaaaagttgaaaattgggatacaaaacggaggagagggaaaaatccaaatcctatccttgtagaaggacagcatgaagccattatttccgatgaattatggagtatggtacaagcaaggcggaaaagtaaatcatttaaacaaaggcaatctaatgaaccatttttacttagcagtcttttacgttgccccgattgtggtcaaggtatggttcctgccattacaacaaataaacgaaaggatggaacaaagaagaaatatcgttattatgtttgctctaactttcataacaaaggttcatctgcatgtagagcaaattcaataaaagcatatgatgcagaatacgaagtaattaataagattgagaagatcctttccaaccaaaatcagttattctctaaacttcaatctataaatactacttcgattgaatctttaaaccaactcaatagtgaattgaaacaattagaaaatcgcctatcagaaatacaagagtacagaatcgttacttggaagcatttgagcaaaagaccttaccaatag

SEQ ID NO: 4149 - DNA, 480 bp, Bacillus licheniformis
gtgaatatatcaatcgtagcaatcggaaaactaaaagaaaaatatttaaaacaaggaatcgatgaatacataaaacggctttcggcatacgcaaaagtcgacatcatcgaacttccggacgaaaaagcaccggaaaacctaagcgaccaggacatgaaaatcgtcaaagacaaagaaggcgaacgaattctctccaaaatcagcccagacgcccacgtcatcgccctggcgatcgaaggaaaaatgaaaagttcggaagaattagccgataatatggatagactcgccacatatggaaagagcaaggcaaccttcgtcatcggcggctcgctcggcttaagcgacgccgtcctgaagcgcgcagatgagaagctgtcgttttcacggatgacgttcccgcatcagctgatgagactgattttgctcgagcaggtttatcgggcttttaggattaatcgaggggaaccgtaccataaatag

SEQ ID NO: 4150 - DNA, 159 bp, Bacillus licheniformis
atgaagtcttgcgaagagcatattgaaacggtcattgacatgtatgtggatgaggaagaattggccccggaaatcagaaaaatcgaacatacacacagtttatccacaacctgtgaattgtgtgataagcctgcagtatatatagtggggaacgaatga

SEQ ID NO: 4151 - DNA, 483 bp, Bacillus licheniformis
atgagtaaggaattagaggaatttccgaaaataaaacccttatatgcggtgttattaacgatcataacgtccggcatatacatcccgtattggtttctctcaagaagaaagaatttagaacgatgccaaattaagctcccgtatgtcgccattaaagtgacgctgctgttaagcgtcttttcaattttggagcctttttggactttttattcaatcacatttcaaagtgaagacctgctgccatacagcaacagcattttgcttctcccgctgcgccccggacacagctttctcccgcagctctcattcctccttttttggacggtaaatttatatagtgcatttaaggttagaaaagcgtttattgggctgtcggaaaagcaggttaacgggttttggactttcattcttaacgtttcatatttgcagtatattacaaatcagcattctttagttgttcaggaaaaaagagaagcagtataa

SEQ ID NO: 4152 - DNA, 522 bp, Bacillus licheniformis
ttgatgttgaaatcgaaaattaaaattgacttgaacaaaccgagaaaaaagccggaaatccgtttgacgccaatgacggaagaggactttaagatataccagacctattccatccagcattacgccatggagaaagtaaaagcgggcacatggacagtggcggaagctatggagaaagcagaagagcagtttgcggcccttttgccaaacggcattgaaacgatcaaccattatctatggtcaatcatgaacgacagcgggaacgccgcaggctgggtttggatctacgctgatccgcaccaccctcaaaaggaagcgtttatttacgatttcgggctttatgaagcgtaccgcggccagggaatcggccagcaggctttagccgtcttagaagaggaggcaaagcaattaggagtcaaaaagctgtccctgcatgtattcgcccataataaaaaagcgaagcgactatatgaaaaaatgaatttcgagacgacagatttgcatatgagcaagagactgtaa

SEQ ID NO: 4153 - DNA, 471 bp, Bacillus licheniformis
atgaacgacaatgtgcaggctgcgttgaaaacgctgtctaatgtaaagagcagaagtatcttgtccgtttttgtgctatgtctgatcacactgggggtttacataccatactggtttctatccaggaaaaaaagcttcgatttgctgccttatcatgatattccctacaccacgttaaaagctatcatattttatcatttattttctattccaattagaatatcagcaaaaatcgcttttcctgacatgcattacagcctgtatatgttgctcgaccgcgtgattttgattctgtccgcaggtgttttgatatactgcgcactggtggtgactgcttcattaaacaagctttcaggcaaagaacctgcgaatggatcgatttttgccttccttttgaatatcatttacattcagcacagaatcaataaactttccgagccgaaaagcgaatggctgagcaaagcatcatga

SEQ ID NO: 4154 - DNA, 846 bp, Bacillus licheniformis
atgagtcagcatgcacttgtattacaatctgattttggccttgatgacggggcggtaaatgcgatgtacggtgtggcttattcggttgacagttcaattcggatttttgatttgacgcacaacattcccgtttttcacatttgtgaagcttcctatcggctgctgcagtccgtttcttattggcctgaaggcactgtcttcgtgtcggtcgtcgatccaggggtcggctcagaacgccgcagcgtcgcagtcagaacctcttccaatcaatatatcatcacaccagacaacggaacactcacccacatcagccggcaaaatggaattgccgaggcgcgctatcttgatgaagcgcaaaacaggcttccaaaatcaggcgaatcacatacattccatggacgcgacatttacgcctacaccggggcaagactggcagccggcgctctcagcttcgacaggatcggtccggaagtttctatagattccatcgtcaaactgccggtcatggaagcgtacatcgaaaatgattggataaccggaacgatcgatattttagatgtccggtttggaaacctttggacgaatatcagccggacgctcttcaagtcacttgatgttcaatacggagatccagtagaagtcgtcatcaagcatgaagacacaaaagtctatcagcaaacgttggcatttggccggtcgtttgccgatatgcctgtaggcaagccggttgtttatatcaattcattagaccgcttgggcattgccctcaaccaaggatcatttgctaaaacataccatattggcacaggcatcaactggcggatttctcttcgaaaaagtatatag

SEQ ID NO: 4155 - DNA, 1212 bp, Bacillus licheniformis
gtggagtttaatcatgatgaggaaaaattcgttcgggaaaagccggtgagaagttggagaagctttttgttttcaagcctggtcggcgccgtcatcggcgctcttttaacagtgtttgccttgccgtatctctcgcagcagggatggctgccgtataatctgcaagtcatcgaagcgcgcggcggccaaggagcacagcagggcgggacggtccgcaatgtatccgtcaacgtgaataatgaagtcacgcaaatggtctctaaggtttctgattctgttgtcggcgttatcaacatccaaaagacaggtgtatgggatggtgacagcgaagcgggaacaggctcgggcgttatttataaaaaggacggcaacacatcccacattgtgacaaaccaccatgtcattgaaggggcgtcccaaatagaaatcagcctgaatgacggaacacggattccggcaaaactgatcggcagcgataagctgatggatctggccgtcctgcaagtcaacagcaacaaaataaaagcagctgccgaatttggagattctgataaagtgaagacaggcgagcctgtcatcgcgattggaaacccgctcggcctgcagttttcaggctctgttacacaaggaatcatctcaggaaccgaacgcgctgtgccggtcgattccaacggagacggacagccggactggaacgccgaagtactgcagacggatgctgccattaacccgggtaacagcggaggcgggctgtttaatattgatggaaaagtcatcggcattaattcgatgaaaatcgctgaatcagccgtcgaaggcatcggtctgagcattccggccaaccttgccattccggttatcgaagatttggaaacgtacggtgaagtgagacggccgtatctcggaattgagatgaaatcacttggcgatatcgcaagctaccactggcaggaaacgcttaaactgccgaaaaacgtaacatcaggcgtagttgtgatgggtgttcagccggtatctcctgcaggcagagccggtctgaaagagctcgatgtcatcgtcgaatttaacggtgaccgtgtttacgatatcgttgatctgcgtaaaaagctttacaccaaaaacgtcggcgacaaggtaaaaatcaaatacctgcggggcggaaaagaaaagacaacagaagtaaagctgacccgatcccaattaggaagctga

SEQ ID NO: 4156 - DNA, 795 bp, Bacillus licheniformis
atgagcctgcaatttagcgtacttgcgagcgggagtaccggtaatgctttatatttggaaaccgatgaccacgcttttttagttgacgcaggacttagcgggaaggcgatggaagggctgatggcgcaaattgatcgaaagcttgatcagctcgacggcatctttgttacacatgagcacagtgaccatataaaagggcttggcgtgctggcaagaaaatatgagctgcccgtttacgccaatgaaaaaacgtggaaggcgatggaagggcatatcggcaaaatggataacggccaaaagttcgtttttccaatggaaaccgtcaagtcattcggctcccttgatgtcgaatcgttcggggtatcccatgatgccgcagagccgatgttttacgtttttcattacaatggccgaaagctcgctttgattacggatacgggctatgtcagcgacagaatgaaaggcatcatccgctcggcaaacgcttttgtttttgaaagcaatcatgatgtcggcatgctgcaaatgggccgctatccgtggaacatcaagcgccggattctaagcgacgtcggacacgtatccaatgaggacgcggcactcgcaatgaccgatgtaatcggcaatgagacatcgagaatttatttggctcatttaagccaggacaacaacatgaaagagctggcaagaatgtctgtgcagcaaacgctggctgccaaaggatttgcggcaggagaaacgtttgacttatatgataccgatcctaagaaaccgacgcctctcgtagcggtgtaa

SEQ ID NO: 4157 - DNA, 849 bp, Bacillus licheniformis
atggagtggaatagaacaaaaacaatcttcattatcgtcttcctcatccttgatatctttttggcctttcaatactttaataagcgcagcaacaatcagtttccgattttagaaaaatcaacgctgcaggaggatatgaaagcagaccatatttcatacggcaatttgtctaaagagacgtcaaaaggctcctcaatctctgcacaaaagcgagtctttaagcaaagcgagattaaatcgttaaaagggcaaaagccgaaggcgttaatgaataccgcaaaagagaacgctttgacagaaatagaaatggagtttgaaacacccattgcgcttccgaaaacggatatgaagacaaaagcaagggaaatcgtgaatgaagagattatcgacggcaataagtacaagctttggaaggtcgataagtccggaaaacagattgttttcttccaaacctataatgggaattacatttttcaggaccggcaaaatgatgataacaacgagatgggcgaagtcgttctgtacctgaataataaaaacgaagtcgtgtcttataagcagtcaatgctgcaggatattaaagaagtcaaaacggaaaatctgatctctgcagtcggcgcggttgaagctttgtactacccggattatttgaagaagtacagcaaaattaaatcagccgagcttggctatttcacgcagtatccgctggcaagcgctcaaattttcgtgcccgtttggcggatcgaagtggagcgcaaaacggacgataaaaccattcacgaagaatttatcgtggatgcacgggacggagcgcttcttcaatcacaagagaaaaaggaaaaatcataa

SEQ ID NO: 4158 - DNA, 1365 bp, Bacillus licheniformis
atgaagcgtgaaacaattaaaacgataatactgtcccttttggttttgatcagtcttctttttacttttaatatttggggatttcaggggaattacgaaaaagttgaagactcacaggctcaggtcagcgacaaacagccgattacaaaccagacaaagttgttaaatgaagccgtcaaaccgcagcaaatgttcattcatgagaatggacagcattatttgctgaatgacacgacgctctattctcagctctgggatgacatgggacgatgggaagtcaaatcgttaaaggatatctcggacaaatttgacaggcagcagttcaaaaactggctatacgctaaaaataaagactccaaattggatctcgtcttcagcgacaacattccgatcgatgtgctgcagccgcttttcaaatggtccgccaattcttatgaatacaactcttttgacagaatcgttcttcctttcaatgaaggacggggcatgaagaagatctattttgtatccttcagcaaagagacggttgttgaagcggtgattgaatcggcaaattaccgcaacatcctttcagacattgaaaaagaaaagtcgcagatgcctctttatgaggattttgcaatcaattcgcgcagagatgtcttgcttccggttaatcggctgaagctgtctgaaaaagagtattttacagaaacgatcagcccgacgcgttttaaaaaagctttatttgatgatccgcaaaccgtgcggcaggaaaccaacttaaacagaccggtatatacggatggaacaagccttttggagatctactcgaacaacagacagattaagttccagcaccgcaacctggaaccgagtacttcttatcaaaatggagagctgatcaataaaagcttcaaatatttaaacgacacgggaagctggacggatgattatcaatttttcggtttgaatgaaaatcagcagatcaactttaatctgtttatggatcagctgccggtcgttaacagccaaaaccagcctttcggaacgacatcgattgaacttcgctgggcaaacaacgacatattggactataaacacccgacatatgtcttgggcgcaaacgcaaatccggtcagcaaaaaggataaagaaatcatgagcggagaagaattgattcagttcctgcaagacaatgaagagtatgactttgataagattgagcaaattttccccgcctatgaaatggtctcagtatcagaggaacaagaccctcttgtcaaacttgtgccgacatggtgcattaaaataaacggtacggtaaagccggtatcaaagaaggattcagcggtgaaggagggcatagaaaatggagtggaatag

SEQ ID NO: 4159 - DNA, 1845 bp, Bacillus licheniformis
atgaataaagtaagtttttttcgctcgattcattttaagtttaccttaatatacgttctgctgattatcgtcgccatgcagattatcggcgtctactttgtcaatgagatggagaagtcacttcttaaatcatataatgactctcttgatcagcgggtgaacaacctatcgtattatctggaacaggaaatgacgaaggatagaagcacatcttcctcgtctaccttgaaggaagatgcagagcggattctaaatgatttcagcaaagaaggcgaaattctcgaagtcagtctgattgataaaagctatgaagtcatcgcgacctccaatccttataaccgggaggtggcggggaaaaagacaacagagggcattatcaaaaggacgctgcttgtcggcattccatacgaaaataaatttttcgacccggagcgggacagcaaagtgcggatttcggtcacaccgattaaaaaatcgaatcaagagacaatcggggccatttacgtcgtggcatcgatggataatgtctacaatcaaatccggacgatcaacaccattttagcgtctggaacttttattgcgcttggaatcactgcttttctcgggatttttgtcgcgcgaacgattacacatccgctgtcagatatgagaaaacaggccattgaactggcgaaaggaaatttctcaagaaaagtcaggaagtacggaaacgacgaaatcggccagctggccacaacgtttaattatttaacaagagagctgaaagaagctcagtccatgacagaaggcgaacgaaaaaaactatcttctgttattgcgtatatgacagacggagttatcgcgactaaccgaaatggcgcgattattttgcttaatacgccggcgctggagcttctaaatgtttcacgtgaaacggctcttgaaatgccgatcacttcgctgctcggccttgaagacgaatacacgtttgaagatttggttgaacagcaggattccctgcttcttgaaattgaacaggaagaacggacgtctgtgctccgcgtcaatttctcggtcatccaaaaagaacacggaaagatcgacggattgattgcggtcatttacgatgtcacagaacaagagcagatcgatcaagagcggagagagtttgttgcaaatgtctcccacgagctcagaacgccgctcacaacgatgcgaagctacctagaagcgcttgcggaaggggcatggcaggatccaaacattgcgccgcgcttcttgaatgtgacacagaatgaaacagagcgcatgatcaggcttgtcaacgacctgctgcagctttcaaagtttgatagcaaagattatcaattcaataaagaatggattcattttatccgtttcttctcattgattattgaacgctttgaaatgacgaaagagcagcatgttgagtttatcagcaatctgccggatagagaattgtatgttgaaatcgatccggacaagattacgcaagtgctggataatatcatttcaaatgcattgaaatattcccctgaaggaggccatatcacgttctctgttgatgtaaatgaagaagaagagcttctttatgtcagtgtcaaagacgaaggtgtcggcattccgagaaaagacgtggagaagatcttcgagcggttctaccgtgtagataaagccagaacaagaagactcggcggtacgggactcggtcttgcgatcgcaaaagaaatggtacaagcccatagcggcgacatctgggccgacagcatcgaaggaaaaggaacaacgatcacatttaccctgccgtataaagaagaacaagaggatgattgggatgaagcgtga

SEQ ID NO: 4160 - DNA, 708 bp, Bacillus licheniformis
atggaaaaaaagatactagttgtagatgatgaaaagccgattgctgatattttagagtttaatctgaaaaaagagggctatgaagtccattgcgcatacgacggcaatgaagcgcttcagatggttgaggatctcaaccctgatatgattctgctcgacatcatgcttccgaataaagacggtgtggaagtgtgccgtgaagtccgcaaaaaatatgatatgcccatcattatgctgacagcaaaggattcggaaatcgataaagtcatcggccttgaactgggcgctgacgattatgtgacaaaaccgttcagcacccgcgaactgctggcgcgtgtcaaagcgaacctgagaagacagaacacagcggctcctgccgaagaagaatcgtcttcaaacgaaattcaaatcggatcgctcgtcatttttccggatgcctatgtcgtttcaaaacgcgacgagacaatcgagctgacacatcgggaattcgaactgctgcattaccttgcaaaacatatcgggcaagtcatgacgcgtgaacatcttctgcaaaccgtgtggggatacgactactttggggatgtccggacagttgacgttacggttagacgccttcgcgaaaaaatcgaggataatccgagtcacccaagctggatcgttacaaggcgcggtgtcggctactatttgagaaatccggaacaggactaa

SEQ ID NO: 4161 - DNA, 411 bp, Bacillus licheniformis
atggaacgtgtcgatgttgtatattcattcgcggaagagaacaacattctgatggtgaaaaacaagaaaaatcaatcatggacattgccgggcggcaaggtggaagctggagaatcgctgacggaagccgcggcgagagaaatgaaggaagaaactggctatggaattcagcctcttgatattttagccgtaaatgaagcggtgatcagcagcgagcatgtatatttcatcgtctttagagcacggatcaccgaccgtccggatgccatcacgtttgacgagaacattgttgaagccaagtgggtgccgcttcatgaagctgaccggctgttgtctgtattccatccgaatggaatcatgcactggctgaaccgcgaaggggcggagtatcatcacgaagggaaaaaataa

SEQ ID NO: 4162 - DNA, 1293 bp, Bacillus licheniformis
atgtcttcagtagttgttgtaggtacgcagtggggtgacgaaggaaaaggcaaaatcaccgatttcctttccgaaaatgcagaggtaatcgcacggtaccaaggcggaaataacgcaggacatacgattaaattcaacggggtaacgtacaaactgcatttgattccatccggtattttttataaggataaaacgtgtgtgatcggcaacggaatggttgttgatccgaaagcattggtaacggagctggcttatcttcatgagcggaacgtcagcacggacaacttgagaatctccaacagggcccatgtcattctgccgtatcacttaaagcttgatgcggtcgaagaagagcggaaaggggccaataaaatcggcacgacgaaaaaaggaatcggcccggcttatatggataaagccgctcgcgtcggaatccggatcgccgatctgttggacagggacgttttcgaagaaaagctcgcccgcaatttggaagaaaaaaaccgtctgctagaaaaaatgtatgatgcggaaggatttaaaatagaagacattttagacgaatactatgagtacggccagcagatcaaacaatatgtctgcgatacgtccgtcgtcttaaacgacgcacttgatgacggccgccgcgtcttattcgaaggggcgcaaggagttatgcttgatatcgaccaagggacatatccgtttgtcacgtcttcaaaccctgtcgccggcggcgtgacgatcggctcaggtgtaggaccgacaaaaatccagcacgtcgttggtgtgtcgaaagcttacacaacgcgtgtcggagacggtccgttcccaacagagctgaacaatgagatcggagaccaaatccgtgaggtcggccgcgaatacggaacaactacaggtcggccgcgccgcgtcggctggtttgacagcgtggttgtccgccatgcccgccgcgtcagcggaattaccgacctttcattaaattcaattgacgtattgaccggtattgaaacattgaaaatctgtgtcgcttacaaataccgcggcgagatcctggaagagttcccggcaagcttaaaagcgctcgctgaatgtgagcctgtctatgaagaaatgccgggttggaccgaagatatcacgggcgcgaaaagcttgagcgacctgcctgaaaatgcccgccattaccttgagcgagtttctcagctgacaggcattccgctttccattttctcagtcggtcctgaccgctctcaaacaaatgtggtgagaagcgtttatcgtccgaactaa

SEQ ID NO: 4163 - DNA, 267 bp, Bacillus licheniformis
atggagacggtattaatttttgcatcagttttatcgccgatcattttggctttggtcgaattggtgaagaagacggtcaaaatgccgaaaaatttgattccgctcgtttcactcttgataggtttgctgatcggtgccgcagcatatccttttacagaccttgaactggtgctccgtttatggtcaggaggactggccggattaacagcgacgggtttatttgaaatcggtaaaaaccgcaatgcaagaaaaaagaaaaatccctga

SEQ ID NO: 4164 - DNA, 1365 bp, Bacillus licheniformis
atgacagatcttctgaatgacaggctgccgccgcaaaatatcgaagccgaacaggccgtgttaggtgctgtttttttagaaccatcagctttaactttggcgtcagaagtcttgattccagatgatttttacagaatgtcgcaccaaaaaatatttaacgccatgcttgttcttggagaccgcggcgagcctgtagacctggtgacggtgacatcagagcttgcgaacacggaccttttggaagaggttggcggcatttcttatttgacggatattgcaaattctgtgccgactgcggctaatatagagtattatgcaaaaatcgtggaagaaaaatcgattctccgccgcttgatccgtacagcaacgacgattgcccaagacggatatacaagggaggatgaagtcgaagacctcttaagcgaagcagaaaaaacgattatggaagtcgcccagcgcaaaaactccggggcctttcaaaatattaaagatgttctcgttcaaacctacgataatattgaacagctccacaacagaaaaggggacatcaccgggattccgacaggttttaccgagcttgacaggatgacggcgggctttcaaagaaacgatttgatcatcgtagccgcccgtccgtcagtcggcaaaaccgcttttgccttaaacatcgcccaaaacgtggcgacgaaaaccgatgaaagcgtcgcgatcttcagccttgagatgggcgccgagcagctggtcatgcggatgctctgtgcggaaggcaacatcaacgcccagaatctccggaccggaaacctgacggaagaggattggggcaagctgacaatggcgatgggaagcttatcaaacagcggaattttcatcgatgacacaccgggaatccgcgtcagcgaaatccgttccaagtgcagacgtttaaagcaggagaacggcctcggcatgattttgatcgactacctgcagctgatccaaggaagcggcagatcaagtgacaaccgccagcaggaagtatcggaaatatcccgtgcgctgaaagcgctggcgagggagcttgaagttccggtcatcgccctttcacagctttcccggggcgtcgaacagcgccaggataagcgtccgatgatgtcggacatccgggaatcgggaagtatcgagcaggacgccgatatcgttgcgttcctgtaccgtgatgattactatgacaaagaatctgagaataaaaacatcattgaaatcattattgcaaaacaaaggaacggcccggtcgggaccgtctcactcgcttttgtaaaagaatataataagttcgtcaacctggaacgccggtttgatgacgcgggtgttgcgcctggtgcataa

SEQ ID NO: 4165 - DNA, 198 bp, Bacillus licheniformis
atgaaggtttatacggtatcaccaaatgccgagacagacgggtggtttttgaaactggaagatacggcgcctgttgagctttatgatacaaggacagaggccgtggaaaaaggagaagagatggcgaaagagaaccgtcctgcgaagcttgtcatctatgaccggcaggacaacaaagaagacgaacggtcttattaa

SEQ ID NO: 4166 - DNA, 279 bp, Bacillus licheniformis
atgacaagtgagttggaagaaaaagaaaaaagcgatataaataaagcggaggtgatcgtcttgaaatcgacgatatcggagctgaaaaagaaattgtatgaacagcagatcagagcaaaagggctttacacatttgaagagtacaaagatatgcgcaatgtgctgcaaacgctgcggatgaaatttgcggcctatgaagaatgggatttgtaccaacatgcgaccgatttgatggtcagcattcccttgaaaaacagttggaacagccgggtggattaa

SEQ ID NO: 4167 - DNA, 1206 bp, Bacillus licheniformis
atgcattacattgacgctcgacgcgcccgtttgaacaatatctttttgattgcaggaatcatatttatcgcttttaatttaagaccggctattacagctgtcgggccattgatcagttcgatccgctcggatatggatttgacgaacggcatggccggcttcttgacgacgctgccgctgttatcgttcgccgtcctgtccccggtcgcccctaagctcggacagaagcttggcaatgagagaaccctctgggtcggattggtcatcttattgatcggaattttgctgcgctcttacggagaatctattacattatttgcaggaaccgcattgatcggagtcggcatcgcaatctgcaatgtgctgctgcccagcctgatcaaacataaatttcctgacaaagcgggaattatgacaagtttctatacaacagccatgtcgatttttgcggcgctcgcatcagggatcagcattccgttgtcgcacggcttagcgtggggatggagcgcgtcgctcatggtttgggcgggcctcgcgtttgttgcgattttgatctgggttccccagctccgctatcatgatacgggaaaccgcacggtcagcttaaaggcagacggccaaacggtctggcgctcgaaaattgcctggcaggtcacattctttatgggcatacagtcgtttttgttttactgcacgatcgcctggctgcctgaaattctccgctcgcacgggatgagcatgtcgcttgccggctggatgctgtcgctgatgcagtttgccagcctcccgtcgacatttttgactccggttctcgccgggcggtttcaaaaccagaaaagcatcgtgctcgccctcggcatcctatacttggcggggatgtcagggctattgtacggaggcagtacagcgatgctgacgctatgggtcattttaatcggaattggacaagggtccagcatcagtttagccttgactttaatcgggctgagaagcgaaaatgccgatcaagccgcggcattatcagggatgtcgcaatccgccggatatttgctggcagcgattggtccaagctttgtcggttttctttacgatcacatgcactcatggaacggaccgattttactgttcatcggcgcgctggtcgctttgatcggtgcaggactcggtgcgggaagaaatcaatatatctatgctaaagcagcataa

SEQ ID NO: 4168 - DNA, 1206 bp, Bacillus licheniformis
gtgaaaaccaaaccatctcaacgctatatttttaaacatcttcatatttacagtgaaaatggaatgatagaagacggttttcttctgacgaatggagaaaaaatcgaggcttacggaccaatggctgatattccagcttccgcacaaacggcagaacagctgacatttccggagaacttcaaagtgctgccgggcatgatcgatgtccacattcacggggcaaacggcgcagatgtcatggacggaacagccgaggctttgcaaacaatggctgaagccctgccgaaagaaggaacgacaagcttcctggcgacgacgatgacccaagataaagccacgatcgagcatgcgctggcaaacgttcaccggtataaggaagccggcggacggcccggaacagccgaagtattaggcgttcacttagagggcccttttatttcagaaaagcggtgcggcgcccagccgccggatgacattatagcgccggatctttcgttatttaaagaatggcagcgcatctcagggaataacattaaattagtcacacttgcgccagagctggaagggtctttggaactaatttcctttttgaaggaaacaggggtcatcgcatccgcaggccattccgacgccggactcaaagagatggaagccgggattaaggccggcctctcccatgtcacccatttgttcaacggcatgcgggggctgcaccaccgcgagccggggactgccggtagcgctcttctgcatgatgaactgaaggctgaagtcattgccgacggcatccatgttcaccctgccgtcatcaagctggcatttcagcaaaaacagaaagaaggcatcattttaattacggatgccatgcgcgcaaaatgcttgaaaaatggaacctatacattaggcggacaggaggtgttcgtaaaaggcgataaagccgttttacgggatggtacgcttgccggcagcatcttgaagatgaaccaggctgcactgaacatgatggattttacgggatgttcactcgaagatatcgtctacatgacagcagtcaatcctgccagacagcttcatatttatgaccggaaaggcagcatacggagcgggaaagatgccgatttgatcattttaaatgaaaaaaatgaagttgtgatgacgctttgcaaaggcgtgattgctttcagcaaaagggaggtttcaccatga

SEQ ID NO: 4169 - DNA, 747 bp, Bacillus licheniformis
atgaagatcattgaagctaaagattatcaggacatgagccaatcagccgcccgattcatcatcgagcaagtgaatcgcttatctgcacctgttctcggccttgcaaccggaggaacgcctctcggcacatatcaggttttaagggaagatcatgcgcgtaataaaacgacttacaagcacgtctatactgttaacttagacgagtatgtcggcgtttccccggatcatgaaaacagctatacattctatatgaaaaaacagcttttcgatcacattgacatcccgctcagccacacccatcttccgaacgggatggcttgtgaccaggatgccgaatgcagccgctatgaagcgctgatcgagcggcttggaggcattgatcttcaagtgctcggcctcggcttgaacggccacatcggatttaacgagccgggcaccccattttcatcgaaaacgcatacggttgaactgacacaatcaacgaaagaagccaatgcccgctattttgattcctatgacgccgtcccgtcgcaagcaataacgatgggcatttccacgatcatgaaaagcaagcagatcctgctgctcgtttcaggagagaaaaaagccggcatcttggcgaagctgctcactgaagaaccaaatgaagacacccccgcttccgtcttaaaaacgcaccaagacgtcgtcatcatagcggacagcgatgctttatcaatcgtgaaagaaaggggtatggccttttga

SEQ ID NO: 4170 - DNA, 732 bp, Bacillus licheniformis
ttgatcaaaaaagattcccacattccgatttactatcagattgagaccgaaattaaaaagcttgccgaaacaaaagatttgaaacccggcgacctcattccttctgaaagagagttcgcagaaaaatatgaggtgagcaggatgaccgttcgacaggcggttaacaatctcgtcaatgaaggcattctcgtccggcagcggggaaaagggacatttattgccgagccaaaaattgagcagcctctcaaaggattgacaagcttttccgaggacatgaaatcaaggggcatgaggcccggcacgaaaatgctcggcttcggcgtcatcccgtgcgaccagagcacagcgcgcaaactggagatacgtgaaggggcttccgtctatgaagtcaaacggatccgcctcgccgatgacatcccgatggcttatgaaatctcctatttgcccgccgacttcattaacggcctgaccgaagacattatgagcgcatctttgtacgactatgtcgaaaatacgctctcccttacgatcgaccgggccgcgcaaacactagaaccggcgattgcctctcaggcagagagcgagcctctcgacatagaggaaggcgcaccagtcctgctcattgaacgcttgagctatttggacgacggcagaccgtttgaagtggtcaaatccgtttacagaggcgaccgctataaattcgtcattgatatgaagaggaaagaccaatga

SEQ ID NO: 4171 - DNA, 897 bp, Bacillus licheniformis
atgaggaagacagagaatacgaacgacaaaagcacagcacttgatgaaatgaatgctttagatatcgtcaccttgatgaatgaggaggatcacacagtccctcgcgccattacgccctgccttcccctgatcgctgaagcggcggagacgattgtcagccgttttgagcaaggcggaagagtgtttaccgcaggcgccggcacaagcggcagaatcgcagttcttgatgccgcggaactgccgccgaccttctctattgacgagagccgttggaccggcctgatcgccggcggatatgacgcaatgtggatgcctcttgaagaaaatgaagatgaccgtgaaaaaatcgtcgctgacctgaaagcgcaatcattctcgaaagatgacgtcttaatcggagtcactgcgagcggttcgaccccttatgtcctcggcgctttatcctatgccaaacagatcggagccgcttctgtttcgatcagctgcaacgcggatacagaagcgggcaaattaagcgatatcgcgattgaggttcaaacaggaccggaaattatccgcggttcaacgcggctgaaagcaggaaccgctcagaaaatgatcttgaacatgctgtcaacagcggcaatggtgaggcttggccgcgtctatcaaaacgagatggtgaatatgaggctgctcaatcaaaaattagccgggcgcgctgtcaccattctgatgaataccaccgggttatcggaggatgaggctctgcaagctttaaaagaaagcggcaatgacatcaaggcagcgatctttatgacgttgacaaacggaacgcttgaagttgcccgccgctgtttatcccatgaaaatggacatttgaaaaaagcgattcaatatcatcgaaaggggttttaa

SEQ ID NO: 4172 - DNA, 1374 bp, Bacillus licheniformis
atgttgggatttcttcaaaatatcggccgcgcgctcatgctgccgattgccgttcttcctgctgcgggcctcctgctcgcactgggacgggaagacctgttaaacattccgtttatcgctgcttcaggacaatcaattcttgaccaacttccgattatctttgcgataggcgttgcgatcggattgtcaaaggatggccacggggccgccgctctgtccggagccatcggttattttgtcctgacaggcggcttagcagccatcaataaggacctgaacatgggagttctcggcgggattattgcaggcgttgtcgccgccgtcatgtataaccgctttaaagatgcaaagctgcctgactggctcggtttcttcggcggaaaacgcagtgttccgattatgacagccttctgttccatcattcttgcaggcattttcggcttcgtctggatttatgcacagcaggcaattgacgccattggaggatggatcattcatgcgggggcattaggggtcgggatattcggtcttttaaacaggctgcttttgccgctcggccttcatcacatcttaaacaacatggtctggatggtctttggagaatttgcaggcaaaacgggtgacatgaaccggttctttgccggagatccaagcgccggcgcctttatgacagggttcttcccgatcatgatgttcggtcttcctgcggcgtgtctggcgatgattgccgctgcgaaaaagcatcgccgcaaagcaacggccgggttgctgatcggattggcgttcacatcatttttaaccggaatcacagagccgattgagttcacattcatgttcctgtcgccgcttctcttcggtattcatgccttgttaaccgcaagcgccatgaccgtgaccaatatgctcggcatccatcacggctttaccttttcagccgggacgatcgactatctcttaaactttggaatcgccacaaagccgctgctcttgcttccgcttggtcttgtttacggcattatttatttcatcatcttttatttcttgataacgaagctcaatttgaaaacgcctggacgagaagatgacgatgagcaggaaaacaccgctgtcagccctgacacaggatcgtctaaatacgaaacccttgcggacaaatacatcgaagcgcttggcggaaaagaaaacatcgagacgctgaacaactgcgtgacccgcctccgcctcaaggtccgcgatgcttccaagctggatgaaagcgcgatgaaatccatgggagcgaagggattcgtcaagctcaatcagcacgaggtgcaggtgatcatcggtacagacgtcgaattcttggcgaatgaaatgagaaaacgtacggaataa

SEQ ID NO: 4173 - DNA, 450 bp, Bacillus licheniformis
atgaaggtaattttcttacaggatgttaaaggcaaagggaaaaaaggcgaagtgaaaaatgtagcggatggatacgcgcacaactttttgatcaaaaaagggctggctgttgaagcgacatccgccaatatcagcgcgcttgaaggtcagaagaaaaaagagaagaaagaagcggctgaagaactgaaatctgcgaaagagctgaaaaaacagcttgaggagattacggtggagctttcagccaagtccggagaaggcggccgtttattcggctccgtgacaagcaaacaaattgcagatgcgctgcaaaaaggccatcagttaaaagtcgacaaacgcaaaatcgaattaaacgatgcgattcgctcattgggatatacgaatgttcccgtgaagctccatccggaagtacaagcaacactgaaagttcacgtgaaagagcaatcataa

SEQ ID NO: 4174 - DNA, 1983 bp, Bacillus licheniformis
gtgccaagtttttatgaaaaaccgttatttcgatatcccatatattctttaatcgtcgtcacaatcatttctgtcctcatcaacatttattttaattgggtggcaggggcggccggcgttctgattctgggtgtcattttgtactttttgaagcgggccgactcccaaatcagaaaagagctggacgattatatatcgacgctgtcttatcgtctgaaaaaagtcggagaagaggcgctgcttgaaatgccgatcgggatcatgctgtttaacgatcagtactatatcgagtgggccaatccttttatggcgtcatgctttaatgaaaatacgctcgtcggccggtcgctttatgatacttgtgaatctgtcgtccctttgattaagcaggaagtggacacagaaacgattacgctgaatgagcggaaatttaatgtggtcatcaaacgggaagaaaagctgctttatttctttgatgtcacagagcagacgcagattgaaaaacaatacgaaaatgaaagaacggttcttgcctacatctttctcgataattacgacgatgtgacgcaagggcttgatgaccagaccagaagctcgataaacagtgaagtaacatcgcttttgaaccagtgggcccaagagtacggcattttcttaaaacgggtttcctctgagcggttcatcggcgtattaaacgaacatattttaagcgagctagaagcatcaaagttttcgattcttgatgaagttcgggagaagacatccgttcataccatttccttgacgttaagcatcggaatcggtgcatctgttgcctcgttgaaagagctcggcgatttggcgcaatccagccttgacttggcgctgggacgcggaggagatcaggtggcaatcaagcagccgaacgggaaagtgaagttttacggcggtaagacgaatcctatggaaaaacggacgcgcgtcagagcccgggtcatttcacacgcgctcaaggagattgtctctgaaagcagcaatgtgataatcatgggtcataagtttcccgatatggattcgatcggatcagccatcgggattttgaaggtcgcacaggcaaacggcaaagacggctttgtcgtgatcgactccaatcagatcggttcaagtgttcaaagactgatcggggagattaaaaaatacgaagaactgtggtccaggtttattacgccggaagaggcgcttgagatcgcaaaagacgacacgctgctcgtgatcgttgatacgcataagccttcttttgtcattgaagaaaggctggtcaataaaattgaaaatatcgtcgttatcgatcatcatagaagaggggaagagtttattaaagacccgctgcttgtctatatggagccgtacgcttcatctacagcggagcttgtgacagagctgctcgaataccagccgaagcgcttaaaaatcaacatgatcgaagcaacagctcttttggccgggattattgtcgatacgaagagcttctcgctgcgcaccggctcccgtacgttcgatgcggcgtcttatctgcgcgcaaaaggcgctgacactgtattggtgcaaaagtttttaaaagaaacggccgatcattatattaaaagggcgaagcttatccagcataccgttttttatcaaaacggcatcgccattgcatcgctgccggacgatgaggcggacgaatactttgaccaggttatcattgcacaagccgcggattctcttctgtctatgagcgatgtcgaagcgtcatttgctgtggcgagaagagacgagaacacggtatgtatcagcgcaagatcgctcggcgaagtaaatgttcaaatcattatggaagcgctcgagggcggcggtcatttaaccaatgctgcgacacagctgaccgatatcacggttgaagaaacgctccgccgactgaaagaagcgattgacgagtatttcgaaggaggcattcagaaatga

SEQ ID NO: 4175 - DNA, 930 bp, Bacillus licheniformis
gtgaaacaaacaagagctttagtagaaggcgctatcatggtcagtatttttgccgttttgctgatgatcagcctctatattcctttcatcggaaccattcttttattgacgctgccgctgcctgcaatggttcaaacgatcaggcacggtctaaagccggggatttcggtggggttggtcagtttacccgtttcattgattgccggttccttaggcggactgatgtttgctattccagtaagtgccgcgggcgtgatcatgggcttttactacagaagaaaagagccggcccaagcgattgctgcagcagccgttacatatatggtttcgttcgtcctgctgcttatcatcagcgttcagtttcttggattaaacttaatagagacggccaatcaagcatataatgaaacattcaaaacctttgaatcgagtatcaaacagtttggaaatgataaagaagtggctaagcagattgaattgttaaatgagcaattcaaacaggcgcaatatttatatccaacggccattgtgatattttccggaatcactgcgtttttgaatcatctgctcgcaaagccggtgcttcggcgcatcatacaaataccgtctctgaaaccgttcagggatatgagacttccgcaaagcattatttggatctatttgttgacgattcttctgtcgctggctcccgttgaagagggcagtgtatattactctgttctgttaaatgcgagtctcatcatgggctttgtcttggtcatccaagggttttcatttgtgttttacttttgccatgccaagaaactgccaactgtcctgccggttctttttttaattatcgggttgttttcgcccctgctgtaccttgttcgcatcttaggtataattgatataggctttaacttgagagaaagagtgaaaaaatcgtag

SEQ ID NO: 4176 - DNA, 477 bp, Bacillus licheniformis
atgacaacaaaaacattggcttggcatgaaacgttggagttgcatgaactaatcgcggcacagtctgtcggattggtgaagatcaagaaaagcatgaagaaaatcagcgaccctcagttaagacagctttacagcgtgtcagcaaaagcattggagcaaaatttaagagagcttcttccctttttgccaaaagctccagcatttcagcgggaggatgaacgggctgacttgtattttgatgcgggtgatctgttggtgctggcgaaaacgaccgttcgaaactatgcgattgcgatcacggaaacggcgacgcccgagctcaggagagtgcttgttaaacaaatcaatgcggccattaagttgcatgaacaagttttttattttatgtaccaaagaggcttatatcccgcctataacctcgtcgacctgctaaaaggcgacgccatgcatgcgcaaaaagcgatatcgatgagataa

SEQ ID NO: 4177 - DNA, 420 bp, Bacillus licheniformis
gtgtatagacatatactgctggctgctgacggttccaagcattctgaaagagctgccgatcatgcgattcatctggcttccatgtcaaacgaagcggtcgtcgacatgatttatgtattggattatgcgagagcaaaacatgaagtcctgcatagcgaaaaccgtacagaactcgaacgcgaacggcgcagcaggctgctgtcgatagaaaataaattaaaacaggcggccgttccctatcaaatgacgatgcagcacggggatccgggcccggccattgtatcgtacgccaaccatcatgatgttgatatcgtgattatcggaagcagggggctgaacactttgcaggaaatggtgctcggaagtgtcagccataaagtggcgaaaagagtgaagtgtccggttttaatcgtaaaatag

SEQ ID NO: 4178 - DNA, 1467 bp, Bacillus licheniformis
ttgaatgttaaacaattaaatagcgaatggttttctaatgtacggggggatatcctttcgggtatcgtcgtagcgcttgctctcattcctgaagccatagcgttctccatcattgcgggtgtagacccgatggtaggtttgtacgcatctttttgtatcgccgttgtcatttcctttacgggcggccgtccggcgatgatatcagccgcgaccggggcgatggctcttttgatgggaactttggtcagagatcacgggcttgattatttatttgctgctacgattttaacgggaatcatccaattaatatttggggtgctgaagattgcgcgctttatgaaatttattccgcggtcggttatggtaggtttcgtaaatgcgctggccattttaatctttatggcgcaggttcctcattttgttggagtttcgaatatgacgtatgttgtggccggtattacgttgttgattatctatgttcttccccgctttacaaaagccgttccatctgcacttgttgccattattgcgatgactgtatttgccattttcggtcattttgatctgcgcactgtcggtgatttgggagaaatgaagcaatcattgcctgcctttatgattcccaatattcctttcaattttgagacattggccattatttttccaacagcctttgcgctttccatcgttggcttgcttgagtcattattaacctcttctattgttgatgatatgacggatacggaaagcgacaaaaacagggaaagccgcggacagggcatcgccaacattgtcgccggttttttcggaggcatggcgggatgcgcgatgatcggccagtctgtgatcaatgtaaaatcaggaggaagaggccgcttgtccacctttgttgccggtgtcttcttaatgtttttaatcatggtgctgggcgactgggtcgtacaaattccgatggcagctttggctggcgtgatgattatggtatcgatcgggacgtttgactggtcttcgtttagcatgttaagaaaggtgccgctgacggattccattgtcatgattgtaaccgtcgttaccgttgtggccacccacgatttatcaaaaggggttttcgccggcgtgattttaagcgcaatcttcttcgtagcgaaaatctccaaactaaaaattgaagaaaagtcagaagaaaacgcggtcaagtacatcatcaaaggacaagttttctttgcatcggttcaagatttcgtaaactcctttaaaacgggagagcaaacgaaaaaggtcattcttgatttttctgaggcccatatatgggatgattccgctgtggcggctatcgataaagtcgttttgaaaatgaaagagcaaggaatagatgttgacttgattggattaaatgaatccagctggaagctggtcgaaaaattagcaacctatgatcaacctcatcgttcagtgtcaaatcactaa

SEQ ID NO: 4179 - DNA, 1302 bp, Bacillus licheniformis
atggcgcaagagctggaaaaacggccggggcatacaagatggtatatttcttctttattaagcagcatgatcattttaaattactttgaccgtgttgccatttcagtcgcagctcctgcgatacaggattcctttcaattgacggcaacccaattaggcatcgtcttttccatctatacctactcatacacgctgatgcagattccggtggggagtctcttggataagtacggcgttgcctgggtgacaagggtcggaatgaccttgtggagttttctaaccattatattggcttttttacagggaaaactgcttctttatattgtcagatttttaatcgggctgacgagtgcttcagcttttcctgccgcatccaaagcaacggccttatggtttccgcctaatgagcgcggccttgccaattccttgtttgactcggcagccaagttcgcgaatgtcatcggcgcgcctctcgtagcctttttagttacgacattcgactggcgagccgcttttttaacgatcggaatcattaatgtactgttcaccgtatttttctggttgtattatgaacagcccgatcggcacaaacgaatctcaaaggaagagctccattatattcaaaagcataatgccgtatcagaggaagatatctcggaacggacgcttattgctttaaaagcgatgctgacaaaccgtaaagtatgggggctgatgatcggatttacgggttacggctatacattcaacctgctcttaacctggctgccgaccttctttaaagaaacatacggaatggacattatgtcctcagggctgtttacagcggttccctggctgatatcgacggtttccggaatcgttgtgggcggatggctcgtcgattttttaattcaaaaggggcattcgaatacaaaggtataccagaccattatcgtaatcggcatgagccttggatttgcctttctgggagctgttttcacgcacaacatcacgattgcgatcatttgcatttccgtcggcttagccggaatatctgcgaccgcgcctatcggctggtcgatatcagccgatattgcaccggttggttccatctctctgctcagttcaatggtcaatttggcaaataacttattcggagggattatcgcggtttcattaacgggctatctggtcgatgtgaccggttcatttacgctcagctttttagtagccggatttgtattactgctcgggctcgtgttctacctcgcagtcctcggcgatataaagcgaattcgtattggcaagcagaaaacctga

SEQ ID NO: 4180 - DNA, 240 bp, Bacillus licheniformis
atggcaggaggacgcagaggcggtcgtgcgaaacgccgtaaagtgtgttatttcacttccaacggcattacgcacatcgactacaaagatgtagatcttcttagaaaatttatctctgagcgcggtaaaatcttaccacgccgtgtaacaggaacaagcgcgaaataccaacgtaaattgactgttgcaatcaaacgcgctcgtcaaatggctttacttccatacgtagcaggcgagtaa

SEQ ID NO: 4181 - DNA, 513 bp, Bacillus licheniformis
atgcttaaccgagttgttttagtcggcagactgacaaaggacccagagcttcgttatactcctagcggtgcagctgttgccacctttacgcttgctgtcaatcgtacgtttacgaatcagcagggtgaacgtgaagctgatttcatcaactgtgttgtctggagaagacaagccgaaaacgttgcaaatttccttaaaaaaggaagtcttgcgggtgtagatggacgtttgcaaacgcgcagctatgaaaatcagcagggacagcgtgtatacgtcacggaagttcaagctgaaagtgttcaatttctggagcctaaaggcggcggttctggttccggcggttacagcggaggccagggaggccaacactttggcggcggacaaaatgaaccggctccattcggcggcagtcaaaacaatcagaatcgcaatcaaggcaacagcttcaatgacgatccattcgcaaatgatggaaagccgattgacatctctgatgacgacttgccattttaa

SEQ ID NO: 4182 - DNA, 288 bp, Bacillus licheniformis
atgagaaagtacgaaatcatgtacatcatccgcccagacgttgatgaagagtctaaaaaggctgttgttgagcgttttaacaacattttaacaactaacggtgcggagatcactgaaacaaaagattggggaaaacgccgtcttgcatacgaaatcaacgatttccgcgacggattctaccaaatcttaaacgttcaagctggagctgaagcagttcaagaatttgaccgtttagctaaaatcagtgacgacatcattcgccacatcgtggttaaagaagaagaataa

SEQ ID NO: 4183 - DNA, 1101 bp, Bacillus licheniformis
atggctttaacagctgggattgttggtttgcctaacgttgggaaatcaaccttatttaatgcaattactcaggccggggcagaatcggccaactacccgttttgtacgattgatccaaacgtcgggatcgtagaggtgcctgatgagcgtctgcaaaagctgacagaactcgtcaatccgaagaaaaccgttcctaccgcatttgaattcaccgatatcgcaggcattgtaaaaggagcatcaaaaggagaagggctcggaaacaagttcctgtcccacatccgccaagtagatgcgatctgccatgttgtccgctgttttgccgatgacaatatcacacacgtgtccgggaaagtagatccgatttcggatatcgagacgattaaccttgagctgatactggctgaccttgaaaccgtggaaaagcggatcgggcgggtcggaaagatggccaagcaaaaagataaagaagccgtgtttgaatttgagattttgacaaagttaaaagaggcgtttgaacaggaaaagccggcccgctctgtcgagttctccgaagagcagcaaaaggtgttgaagcagcttcatctgctgacgacaaaacctgtcttatatgtagctaatgtcagcgaagatgaagtggctgatccttcaggtaacgagtacgttcagaaggtccgggaatttgcagctgctgaaaatgcggaagtcatcgtcgtctgcgcaaagattgagtccgaaattgcagagcttgaaggcgaagagaaggcgatgttccttgaagaactcggcattgaagaatccggtctcgatcagctgattaaagcgtcctactccctcctcggacttgctacttattttacagcgggagaacaggaagtcagagcttggacatttaaaaaaggaatgaaagcccctgaatgtgcgggcatcatccatacggactttgaacgcggatttatccgtgcggaaacggtcgcctacgacgatctgcttgaagcgggaagcatgaccgcagcaaaagaggccggaaaagtccgccttgaagggaaagaatacattgttaaagacggcgatgtcattcatttccgtttcaatgtataa

SEQ ID NO: 4184 - DNA, 207 bp, Bacillus licheniformis
ttggccgataaagaatttggcctgaatgacgtggtcgaaatgaaaaagccgcatccctgcgggacaaaccgctggaagatcattcggatgggaatggatatccggatcaagtgcgagggctgttcacacagcgtcatgatcccgcgcaaagagtttcaaagaaagctgaaaaagatattagttaagcatgaggagtccgaaagttaa

SEQ ID NO: 4185 - DNA, 1014 bp, Bacillus licheniformis
gtgtggagagccgggatgaagtggatgcttcttattttaggaagcttaataggtgcgggatatgcatccggccaggaaatatggcagttttttggtgatgaaagcggactggctatcctgttgtttacgatcatgttcagcctgtcaacctatattgtgatgaagatcagctatgaacaaaaatcagagcattttctgcctgtgctcgaaacattaatcggtccgatgctggctaaagtatacgatgtgctgatcatcctgtatttgtttacgacgacgattgtgatgattgcaggaggcggggtaacgctgcaaatctttcatatcccgttttggactggcgtcatcttgttttgtttatgcacagggttgttgtttttgtgggggctcaatggcatattgtccgttaatagctacttaatcccgattttggtggcggggctgctgtatgcgctgatttcttttcaaacagctcatcatcagccgtggctgctcaacttgactcatcaatacaactggcctgccggcatcgcattcacttccctgaacatattatctgttgtcgctgtattatctgcggtcggcaaagagatgaagggggtcggagaagcaaagattgccagcatattaagcggcctggtgtttggggctatttcatacatgtacaatgagacccttgtagagcttgccggtgaactggcccattatgaaattcctttattcgcggttttggagggcgcgccttttccgatttttatttttatgacggctgtactttgcgtcgcaatctatacgacgacgatctcgagcattctcggtctgtccagccgttttctgtcctttgtgaactggccgagatgggtgatcgtcatcctgcttctctcgatcatggctccttttacgtcaatcggattttcaaatttaatcgcttttttatatccaatttacggattattgaatttatatttattggtaaatattttactatatccgattttgagtaaatggaaataa

SEQ ID NO: 4186 - DNA, 618 bp, Bacillus licheniformis
atgaatcgaaaaggcggaattttttctcaagaaccaatgaatgaatatatttctcatacggatccgctagctgttaaacaaatagagaaagtcctttccgtctatttaaaggaagccggagaccggcccatcgtgatcgtttgcatcggtacagaccgctcgaccggagattcgctcggtcccctcgtaggaatgaaactctccgcaaagcagctgacacgttttcatgtctatggaacgcttgccgacccggttcacgccgtgaacttaaatgaaaagcttgatcatattcatcagcagcatcaaaatccttttatgatcgcgatcgacgcctgtcttggacgaaccaaaagcgtggggtctttccaaatcggcaaagggcctttgaagccgggagcaggcgttcagaaaagtttgccggaagtcggccacgtgcatattaacggaattgtcaatgtcagcggttttatggagtattttgtcctgcaaaatacaaggctcaatcttgtcatgagcatggcaaatgtgcttgcggacgggctgtcgcatctggaaaagaccggatcgcagcggcgccatgtgtcaccaattgaaagaatgaccggaagaatgtcataa

SEQ ID NO: 4187 - DNA, 849 bp, Bacillus licheniformis
atgcctaaaggtctcggaaaagggattaatgcattgttttcaaatgttgatttatccgaagaaacggttgaggaaatcaagctgcaagacttgcggcccaacccttatcagccaagaaaaacgtttgatgaccaatcgttaaaagatttgaaggagtccattttgcagcacggtgttttgcagcccatcatcgtcagaaagtcaattaaaggctatgacattgtggccggagaacgccgtttccgggctgctgaaaaggccggattggaaaccattcctgcgattgtgcgcgagctgtcggaatccctgatgatggagattgccctattggaaaatcttcaacgagaagacctgtctccgcttgaagaagcaaaagcctatgaatctttgctcaaacatctcgatatgacccaggaacagctggcgaaaaggcttggaaaaagcaggcctcacatcgccaaccacttgcggctgctgacacttcctgaagacgttcaaaagttaatcgacaacggcacgttatcgatgggccatggccgaacattgcttggattgaaaaacaagaaaaagcttgagccgcttgttcaaaaggtcgtgtccgaacagttgaacgtccgccagttggaaaagttaattcaacagttgaacgctgatgttccacgtgaaacaaagaagccgaaacaagtcaaagatgcagtgatcaaggaacgggaatcgtatttgcgaaactattttggaacaccggtgaccattaaaaagcaaaagaaaaaaggcaggatcgaaatcgaattctactcaaatgaagacttggagcgtattctcgaattattggctcaagaagacgcataa

SEQ ID NO: 4188 - DNA, 789 bp, Bacillus licheniformis
ttgttcaatgtgaaagtaggtgacattgtggggaaaattattgcgatcacaaaccaaaaaggtggcgttggtaaaacgacaacctctgttaacctgggagcttgcttagcttacatcgggaaaagggttttgttagtcgacatagacccgcaaggaaacgcaacaagcggtatcggcgttgaaaaggctgatgttgatcaatgtgtgtacgatatattagtagatgatgcagatgtgaaagatgtcatcaaaacaacatccgtagaaaacttggatgtcattcctgcaacgatccagcttgcgggggcggaaattgaacttgttccgaccatctcccgagaagtccggctgaaaagggctttggaatcggtcaaacaaaactatgatttcatgattattgactgcccgccgtcattagggctgcttacaatcaatgcgcttacggcttccgattccgtcgtgattccggtccagtgcgagtattatgcgctggaagggctgagccagctgctcaactctgtccggctcgtgcaaaaacatttaaatacggatctgatgatcgacggcgtattgctgacaatgcttgatgcaagaacgaatttaggcatacaggtcatcgaagaagtgaaaaagtacttccgcgataaagtatacaaaacggttatcccccggaatgtccggctcagtgaagcgccgagtcatggaaagccgatcattttatatgatccccgttccagaggagcggaagtctatttagaattagcaaaggaagtggctgcgaatgcctaa

SEQ ID NO: 4189 - DNA, 444 bp, Bacillus licheniformis
atggaaacgagatttctaatggaaaaagtaaatcctgagggatacagaggaatgctggagcttgaaaaagcgcaggcttcttctggcattgaccccattttaaaggaactgatcaaaatccgggcttcacagctgaacggatgtgctttctgcttaaatatgcatacgaaggatgcaagacagaacggggaaacggaacagcggatatatgcgctcaatgcgtggcgggaagcgccttttttcacggaaaaagagcgggctgtattggcgctgactgaagccgttacgcgaatcggcgagcacgggttgccggatgaaatatacaacgaagtcaggacccattttacagaagctgaaacagccgaactgatcatggcagctgtcacaataaatgcctggaacaggattgccatcgccacccggaaaatgcccgcagcagattga

SEQ ID NO: 4190 - DNA, 858 bp, Bacillus licheniformis
atggaatattatcgacaatatcattcattgcttttttcgattgcttaccgtatgctcgggtcttttcaagatgcagaggacatcatccaagaattgttcgcagaccttcaggaaaaagatatcggtcaaattgaccatattcaagcatatttaacgaaatcaatcacaaaccgctgcataaatgaactgcagtctgcccgcaagaagcgggaggtatatatcggggaatggcttccggaaccgcaggtggcgctttcagctcaaatcccggctgagtacgttgaagagaaagaaaaggtatcctatgcttttctggtagttatgagccgattaaatcctgtagaaagagccgttttgatgtttagagaagtatttggatatcattacaaggaaatttcgtccattatcgggaagtcggaagcgaactgtcgtcaaatccacagccggctgaaacagaaattaaacgaggatatttcggtattttcacagccggttgaagaacagcaattggcccagctgtttatcgaatcagcgaaaacaggtaattttgaggagttttccaagaaattgattgaagatgccgtattgtatacagatggcggcggaaaagtgcgcagcgctttgagaccgatctatggaaagagccgcatttatgcgttttttacgggagttgtttcaaagggaagcttttccggccgctttatgccagtcgatatcaacgaccaaaagggcgttttgatcatgaaaaacaaccgcccggcttacgcggtttgctttgcttggaatccggaaggcgattccgtcaaaaatgtgtttatcgtgtcaaatcccgataaactgaagcacattaaaatataa

SEQ ID NO: 4191 - DNA, 852 bp, Bacillus licheniformis
atgaagcattcattctctcgtctcttcggacttggcgacaaggaagaagaagcagagattgctgaacatgatacgaataaagaagaaattcaagagattccagtaggcgatataattcctaaccgttttcagccgcgcaccattttctcagaagaaaaaattaaagaattagctgcaaccattcatacacacggcattatccagccgattgtcgtcagaaaaacagagcgggaaggccaatatgaactcatagccggagagcggcgctggcgggcggttcaaacgctcgattgggagaaggttcccgctattattaaggatttttcagatacagagaccgcttctgtcgctcttatcgaaaaccttcagagggaagaattatcttcgattgaagaggcgcatgcttatgcaaggcttttagagcttcacgatttgacgcaggaagcccttgcacaaaggcttggaaagggccagtcaacaatcgccaataagctcagactgttaaagcttccggaagaggtgcaggaagcgatcttgaaaaaagaaatttcagagcgccacgcaagagcgctcataccgttgaaacagcccgaccttcaggtcaagctgctgcatgaagtcattgaaaagagtttaaatgtaaaacaaaccgaagaccgtgtcgtcaaaatgcttgagcaggataaacgcaagcctaaaccaaagagaaaagcgtacagcagggacgcgagaatcgcgatgaatacgattcgccagtccttatcaatggtggaagacagcggcgtcaaactgaatacggaagaagaggaatttgaagaatatattcagtttacgattcgaataccgaaataa

SEQ ID NO: 4192 - DNA, 720 bp, Bacillus licheniformis
atgaacattgagcaatttacagccggtttggagaagaaaggcatttccctttcctccttccagctggagcaatttgagacttattacgaatggcttgttgaatggaacgaaaaaatgaatttaacctcgattaccgagaaaaaagaagtgtacttaaagcatttttacgattccatcgccgcctctttttatgttgatttcaaaaagatgaacactctctgtgatgttggagcgggtgccggatttccaagccttccgattaaaatctgctttcctcaccttcacgtcacaatcgttgactcactgaacaaacggattcactttttgaatcagctgtcagacgctttgaagctggaaaacacagctttttaccatgaccgcgcggaaacattcggaagatcgaaagaccacagagaaagctatgacgttgtgacggcacgcgctgtcgcccgcctttcggttctcagcgagctctgccttccgcttgtgaaaaaagacggtttattcgtagcattaaaagccgcttcggctgatgaagaaattgaaacgggcaaaaaagccatcaaaacgcttggaggcaaaattgaaaccgtacattcttttcagctgccaatagaagaaagcgaaagaaacatcattgtcatcaaaaaacaatcgcagacaccgaagaaatttccaagaaagcctggaacacctaataaatctcctattgaaggttaa

SEQ ID NO: 4193 - DNA, 1887 bp, Bacillus licheniformis
atgggctatgaagcaggccaatatgacgtcgttgtcgtcggcgccggacacgccggtgttgaagcggcgctggcgtcagccagacaaggcgcaaaaacgcttgtcttaacgattaaccttgatatggttgctttcatgccatgtaacccgtctgtcggcggacctgcaaaaggaatcgtcgtccgcgaaattgacgcgctcggcggggaaatggctaaaaatattgataaaacgcatatccaaatgaggcttttaaatacaggaaaaggacctgccgttcgggcgcttcgggctcaggctgataaattccaatatcagcatgaaatgaaaaagacacttgagaatgaaccgaatttgaccatgctgcaaggaatggtcgaacgccttcttattgaagacggggaatgccggggcgttataacccagacaggggcggagtaccgttctaagaccgttgttctgacgacggggacatttttgagagggaaaatcattcttggcgatctgtcatactccagcggaccgaacaaccagcagccgtccatcaagctgtctgaacatcttgaagagctcggctttgacctcgtccgttttaaaacagggacgccgccgcgggtcaacagtcattcaattgactacagcaaaacggaaatccagcccggtgatgaagtgccgcgggccttttcgtatgagacggtggaatatattacagaccagcttccatgctggctcacatatacaagtccggaaacgcacgaaatcattgacaacaatttgcatcgttcaccgatgtactccggcatgatcaaaggaacgggaccgagatattgcccgtctattgaagacaaggtcgtccgctttaacgacaagccgagacaccaaatctttcttgagcctgaagggcgcaacacccaggaagtctatgtccagggattgtcgacaagccttccagaagatgtgcagcgaaaaatgctttcaactattcccggccttgagaatgtgcaaatgatgcgggcggggtatgcgattgaatatgatgcgatcgtaccgacacagctgtggccgacattggaaacgaaaaaaattccgggactcttcacagccggacagattaacggaacatcaggctatgaagaagcggccggacagggaattatggccggtatcaatgcgggccggaaagcgcttggcaaagaagaggtcattctcagccgctcagacgcttatatcggcgtattgatcgacgaccttgtgacaaaaggaacaaacgaaccataccgcctgctgacttcgcgtgcagagtacaggctgctcctgcgtcacgacaatgcagacttgcgcctgaccgagatcggctatcagatcggcttgatttctgaagaaagatatcaaaagtttcaagagaaaaaagcggccattgaagcagagaaaaaacgccttcattctgttattatcaaaccgacaaaggaaaatcaggaatatatccgttcactgggcggcagcgagctcaaagacggcattcgcgcgaccgacctgatgaagcggcctgaaatgaattatgaaaccgtcactgctcttgcgccgcctgaacaaaaagtcgccggcgacgttgccgaacaggtggaaattcaaattaagtatgaaggatatattgaaaagtccttgcagcaggtcgaaaaactaaagaaaatggaaaataaaaagattcctgacagaatcgactatgacgcgatcaaaggcattgcaacggaagcgcgccaaaaattgaaagaggtcagaccgctgtctgtcgcacaggcctcacggatttccggcgtcaatcctgctgatatttccatactgctcgtttatttagagcagggacggattgccaaggttgcggaatag

SEQ ID NO: 4194 - DNA, 1380 bp, Bacillus licheniformis
atggataccatcgctgcgatttcaacgccgatgggagaaggggcgattgcgatcgtccggatgagcggccctgaggctcttgcgatcgccgataaagtgtataaaggacctcgcggaaaaaggctgagttccgtcgattcacatacgattaactacggtcatatcgttgatccggaaacggaaaaagtcgtggaagaagtcatggtttcggtactgaaagcgccgaaaacttttacgcgggaagatattgtagaaatcaactgccacggcggacttgtgactgtcaaccaggtgcttcagctcgttttgagagagggagcgcgtctggcggaaccgggagaatttacgaaaagagcctttttgaacggaagaatcgatctttcccaggctgaagctgtcatggatctcatcagggccaaaacagaccgggcaatgaatgtggccatgaatcagatggaaggaaggctgtcttcactgatcaaacggttgagggccgagattcttgaaacattggcccacgttgaagtgaatattgactatccggaatacgatgacgttgaagaaatgacgcacaagatgctgattgaaaaagcgacaaaggtcaaaaaggaaatcgaggcgctgctgacgacttcagagcagggtaaaatattaagagaaggcatctcgacagttatcatcgggcggcccaatgtcggcaagtcctcgcttttaaacagtctcgtccacgagacaaaagcgatcgtaacggatattccgggcacgacgcgggatgtcattgaagaatatgtgaatgtcagaggcgtgccgctgcgtctcgtcgatacagccgggatccgcgagaccgaagacatcgtcgagcgaatcggcgttgaacgttcaagacaggtattaaaagaagcagatttgattttgcttgtcctcaattacagcgagtccctttcagatgaagacatcaagctctttgaagcaacgaagggaatggacatcatcgtcattgtcaataagaccgatcttgagcaaaagcttgatcttgatcgggttcgggaattggctgggaatcagcctgtcgtgacgacttccttattaaaagaggaagggattgatgagctggaggaagccattcaatcgctgtttttcacaggcgcgatcgagagcggcgacttgacatatgtcagcaatacaaggcatatttcactgctgcatgaggcgaagcgcgccatcactgacgcattggagggcatcgaaaacgatgtgccgatcgatatggttcaaattgatttaacaagatgctgggaagttcttggggagatcattggcgatgctgtacacgaaagtctgatcgaccagctcttctctcaattttgcttaggaaaataa

SEQ ID NO: 4195 - DNA, 624 bp, Bacillus licheniformis
gtgaaggaactgactgctactggacgtaccgtcgatgaagcagtgcaatccgggcttgaacagctgggccttcatgcagatgatgtcgaagtcgacgtagttgatgaaggaaaaaagggattattcggcattttcggtcatcggtctgcagtcgtgaacattcgggaaaaaatagacccggttaaagaagcaaaacaatatttggaaaatgtaatttcgaatatgggaatacaagcccaggtgacggcagaagaggagtctaaacgagtggtttttcagttgaaaggagacaaaacagctcttttaattggaaaaaggggacaaactttaaatgcccttgaaacgctgacgcagctcgtgctcaatcgtcattccgacagatatatccaagcggtggttgacgccgaaggataccgcgcaaagcggaaggaaacacttgctcagctggcattgaagcttgctgaccaggcggccaggcagaaaaaagacattcacctggagccgatgccttccagtgagcgcaaggtcatccatgatacgcttgcgggctactcgcagcatatcgaaacttactctaccggtgaagaccataaccggcaccttgtcatctcatataaaaaataa

SEQ ID NO: 4196 - DNA, 795 bp, Bacillus licheniformis
ttgaagaggcgaattttattattgttcagtatgatcggcgttatcgtgcttttagctggatgtacggaaatcaaccagccgatcactgcagaaagcgaagggttttggaacacgtatatcgtatacccgttgtcacagctgatcacgtatgtagcaaatttaacgaatgaaaacttcggactagcgattatcatcgtcacgatcttaatcagacttttaattttgccgctgatgatcaagcagacgaagagttcgaaagcgatgcaggctctccagcctgaaatgcaaaaacttcgtgaaaaatacagttctaaagatcaaaaaacgcagcagaagcttcaacaggaaacgatggctctcatgcagaagcacggggttaacccgcttgccggatgtttcccgatcttaattcaaatgccgattttaatcggattctatcatgccattatgagaacgcgggaaatcgcagaacacagctttttatggtttgaccttggggagcgtgatccgtatttcattttgccgattctcgccggtgtgttcacattcattcagcaaaagctgatgatggcgggaacagcgcagcaaaatccgcagatggcgatgatgctttggctgatgccgatcatgatcgttgtatttgcgatcagtttcccggcggctctttccctgtactgggtagtcggtaacttattcatgattgctcaaaccttctttatcaaagggcctgatctaaaggctgagagacaggaagcggcagccggaggaaaaaaatccggaggtaagaaaaagtga

SEQ ID NO: 4197 - DNA, 360 bp, Bacillus licheniformis
atgaaaaagcgaaatcgattaaagaaaaatgaagattttcaaaaagtatttaaaaagggaaaatcgatggcaaaccggcaatatgttttatatgtgcttcaccagcctgaagcgaaagagtttcgggtgggactgtcggtcagcaagaaaatcggaaacgcagtcgtgcgcaaccgggtaaagcggctgattcgccaggtcatccaggaagagcggaatctattaaaacaagaaaatgactacattatcatcgcaagaaagcctgcagctgaattatcatatgaagagacgaaaaaaagtttgcagcatcttttcagaaagtcgtttgtctaccggaaaaaaccgaatcagccatcatag

SEQ ID NO: 4198 - DNA, 135 bp, Bacillus licheniformis
atgaaaagaacatttcaaccaaataaccgtaagcgcagcaaagttcatggctttcgcagccgtatgagttctaaaaatggacgtcttgtattagcacgtcgtcgccgcaaaggaagaaaagtattatcagcttag

SEQ ID NO: 4199 - protein, 446 aa, Bacillus licheniformis
MKNISDLWNQALGQIEKKLSKPSFETWMKSTKAHSLQGDTLIITAPNEFARDWLESRYLHLIADTIYDLTGEELSIKFVIPQNQNEEDFMPKSPIKKMSKEEPADFPQNMLNPKYTFDTFVIGSGNRFAHAASLAVAEAPAKAYNPLFIYGGVGLGKTHLMHAIGHYVIDHNPSAKVVYLSSEKFTNEFINSIRDNKAVDFRNRYRNVDVLLIDDIQFLAGKEQTQEEFFHTFNTLHEETKQIVISSDRPPKEIPTLEDRLRSRFEWGLITDITPPDLETRIAILRKKAKAEGLDIPNEVMLYIANQIDSNIRELEGALIRVVAYSSLINKDINADLAAEALKDIIPSSKPKVITIKDIQRIVGQQFNIKLEDFKAKKRTKSVAFPRQIAMYLSREMTDSSLPKIGEEFGGRDHTTVIHAHEKISKLLSDDEQLQQQIKEIKEQLR

SEQ ID NO: 4200 - protein, 378 aa, Bacillus licheniformis
MKFTIQKDRLVESVQDVLKAVSSRTTIPILTGIKIVASDEGVSLTGSDSDISIESFIPKEDGDLEIVTIEQPGSIVLQARFFSEIVKKLPMSTVEIEVQNQYLTIIRSGKAEFNLNGLDASEYPLLPQIEEHHAFQIPTDLLKNLIRQTVFAVSTSETRPILTGVNWNVTGGELICTATDSHRLALRKAKLDINEDSSYNVVIPGKSLTELSKILDDHQELVDIVITETQVLFKTKNVLFFSRLLDGNYPDTNRLIPQESKTNLIVNTKEFLQAIDRASLLAREGRNNVVKLSAAANESIEISSNSPEIGKVVETVNAEQIEGEDLKISFSPKYMLDALKVLEGEDIHVSFTGAMRPFLIRTPNDDSIVQLILPVRTY

SEQ ID NO: 4201 - protein, 58 aa, Bacillus licheniformis
MTKTVAIDTEMITLGQFLKLADVIQSGGMAKWFLSEYEVLVNDEPDNRRGRNCMSEMW

SEQ ID NO: 4202 - protein, 370 aa, Bacillus licheniformis
MYIQNLTLSSYRNYERLDLQFENKVNVIIGENAQGKTNLMEAIYVLAMAKSHRTSNDKELIRWDEDYAKIEGRVIKKNGSVPIQLVISKKGKKGKVNHIEQQKLSQYVGAVNTIMFAPEDLNLVKGSPQVRRRFLDMEIGQVSPVYLHDLSLYQKILSQRNHFLKQLQTRKQTDQTMLDVLTEQLTEFAAKVVMKRLQFVDQLEKWAQPIHSGISRGLEELTLKYHTSLHVSDSPDLSKMINSYQETFSKLRDKEIERGVSLSGPHRDDVLFYVNGRDVQTYGSQGQQRTTALSLKLAEIDLIQEEIGEYPILLLDDVLSELDDYRQSHLLHTIQGRVQTFVTTTSVDGIDHKTLNEAEIFRVENGTLSD

SEQ ID NO: 4203 - protein, 80 aa, Bacillus licheniformis
MYIHLGDDFVVSTREIVAIFDYKAKTSPIVEEFLSKQKQRIVSSNSTPKSIVVTLQSIYFSPLASGTLKKRAQSKPEIDS

SEQ ID NO: 4204 - protein, 639 aa, Bacillus licheniformis
MAMEQQNNYDENQIQVLEGLEAVRKRPGMYIGSTSGKGLHHLVWEIVDNSIDEALAGYCTEINVAIEKDNSITVKDNGRGIPVGIHEKMGRPAVEVIMTVLHAGGKFDGSGYKVSGGLHGVGASVVNALSTELDVTVYRDGKIHYQEFERGVPKADLKVIGDTEVTGTTTHFKPDPEIFTETTEYDYDTLATRVRELAFLTKGVKITIEDKREGKERKNEYCYEGGIKSYVEHLNRSREVIHEEPVYIEGSKDGITVEVALQYNDSYTSNIYSFANNIHTYEGGTHEAGFKTGLTRVINDYARRNGVFKESDPNLSGEDVREGLTAIISIKHPDPQFEGQTKTKLGNSEARTITDALFSEALEKFLLENPDSAKKIVEKGVMAARARMAAKKARELTRRKSALEVSNLPGKLADCSSKDPTISELYIVEGDSAGGSAKQGRDRHFQAILPLRGKILNVEKARLDKILSNNEVRSMITALGTGIGEDFNLEKARYHKVVIMTDADVDGAHIRTLLLTFFYRYMRQIIEQGYVYIAQPPLYKVQQGKRVEYAYNDQQLEEILKELPQNPKPGLQRYKGLGEMNATQLWETTMDPETRTLLQVTLKDAIDADETFEMLMGDKVEPRRNFIEENARYVKNLDI

SEQ ID NO: 4205 - protein, 822 aa, Bacillus licheniformis
MSEQHKPQVQEVNISQEMRTSFLDYAMSVIVSRALPDVRDGLKPVHRRILYAMNDLGMTSDKPYKKSARIVGEVIGKYHPHGDSAVYEAMVRMAQDFNYRYMLVQGHGNFGSVDGDSAAAMRYTEARMSKISMEILRDINKDTIDYQDNYDGSEKEPVVMPARFPNLLVNGAAGIAVGMATNIPPHQLGEVIDGVLAVSKNPDITLPELMEIIPGPDFPTAGLILGRSGIRKAYETGRGSITLRAKAQIEETSSGKPVIIITEIPYQVNKARLIEKIADLVRDKKIDGITDLRDESDRNGMRIVIELRRDANANVLLNNLYKQTALQTSFGINLLALVDGQPKVLSLKQCLEHYLDHQKVVIRRRTAFELRKAEARAHILEGLRVALDHLDEVISLIRNSQTAEIAKNGLIEKFSLTEKQAQAILDMRLQRLTGLEREKIEEEYQSLVELIAELKAILADEEKVLEIIREELTEVKERFNDERRTEIVTSGLETIEDEDLITRENIVVTLTHNGYIKRLPSSTYRSQKRGGKGIQGMGTNEDDFVEHLISTSTHDTILFFSNKGKVYRAKGYEIPEFGRTAKGIPIINLLEVEKGEWINAIIPVGEFDDESYLFFTTKHGISKRTPLSQFANIRNNGLIALSLRDEDELIAVRLTDGNKQIIIGTKNGLLIRFPETDVRQMGRTAAGVKGINLTDDDVVVGMEILEEDSHVLIVTEKGYGKLTPASEYRVQSRGGKGLKTCKITENNGSLVTVKATTGEEDLMIITASGVIIRMDIKDISTTGRVTQGVRLIRLGEQEHVATVALVEKDEENDSEEQEADES

SEQ ID NO: 4206 - protein, 325 aa, Bacillus licheniformis
MQDKGWKDLKLFYSVETAQHFLEMVYKNQGMEDAKKNSYKNGERFIFFLKHAEAFYKQAKIATLEIKPILLFYGMAQLLKACLLMTDPSYPSHTSVLAHGVTTRKRKKQNYRFYEDEVKIQRNGLCMHVIRSLFQLSGLEDERFNMKQLLARIPEINKVLAFQRKPNPIVKAAVEDRLIWLPSETPDAYNMSSKRFIEHVEYHLNWSFCREEKEGIIFSAAQKECRPSTSTTLLYDLEHGAYYFPAERDRFLKLPEILVHYLVAYNVSMIARYETQWWYDLLLQSASDDYVIIQQFLHIVESKFPYYIAELLIRKKENNKKDQLI

SEQ ID NO: 4207 - protein, 488 aa, Bacillus licheniformis
MWESKFSKEGLTFDDVLLVPAKSEVLPRDVDLSVELTPSLKLNVPIISAGMDTVTEAQMAIAMARQGGLGIIHKNMSIEQQAEQVDKVKRSERGVITNPFFLTPEHQVFDAEHLMGKYRISGVPIVDNEEDQKLVGIITNRDLRFISDYSMKISDVMTKEELVTAPVGTTLDEAEKILQKYKIEKLPLLDDQGVLKGLITIKDIEKVIEFPNSAKDVHGRLLVGAAVGVTGDTMTRVRKLVEANVDVIVVDTAHGHSQGVLDTVKKIRDTYPELNIIAGNVATAEGTKALIEAGANVVKVGIGPGSICTTRVVAGVGVPQVTAIYDCATEARKHGAAIIADGGIKYSGDIVKALAAGGHAVMLGSLLAGTSESPGETEIYQGRRFKVYRGMGSVAAMEKGSKDRYFQEENKKFVPEGIEGRTPYKGPVADTVYQLVGGLKSGMGYCGTKDLHALREDAQFIRMTGAGLRESHPHDVQITKESPNYTIS

SEQ ID NO: 4208 - protein, 441 aa, Bacillus licheniformis
MKSKRLKQLIMLIVAFAVTVGAFSPMSTAKAANDPINVDAKAAILVEASSGKILYSKNADQRLPVASMAKMMTEYLLLEAIHEGKVKWDQKYTPDDYVYEISQDRSLSNVPLRKDGSYTVKELYQATAIYSANAAAIALSEIVAGSESKFVELMNKKAKELGMKDFKFVNATGLENKDLHGKHPSGTNANEENEVSARDMALLADHLVSDYPEILDTASIAKTKFRKGTDDEMDMPNWNFMLKGLVQQYEGVDGLKTGSTDSAGSCFTATAERNGMRVISVVLNAKGDLHTARFKETKKMLDYAFENFTMKEFYAKGAQVKGNETVTVDKGKETEVGIVTEKAFSMPVKNGEEKNYKAKVTLNKDELTAPVKKGEKVGTLTASYKGEEKDYGFLGSDVSGVNLVTKEDDEKANWFILTMRSIGGFFAGIWNSIVEMVTGWF

SEQ ID NO: 4209 - protein, 294 aa, Bacillus licheniformis
MAQTGTDRVKRGMAEMQKGGVIMDVVNAEQAKIAEEAGAVAVMALERVPADIRAAGGVARMADPTIVEEVMNAVSIPVMAKARIGHIVEARVLEALGVDYIDESEVLTPADEEFHLNKNEFTVPFVCGCRDLGEATRRIAEGASMLRTKGEPGTGNIVEAVRHMRKVNAQVRKVVGMSDDELMTEAKNLGAPYELLKEIKAEGRLPVVNFAAGGVATPADAALMMQLGADGVFVGSGIFKSDNPAKFAKAIVEATTHFTDYKLIAELSKELGTAMKGIEISNLLPEQRMQERGW

SEQ ID NO: 4210 - protein, 196 aa, Bacillus licheniformis
MLTIGVLGLQGAVREHIRSIEACGAAGKVIKWPEELKEIDGLILPGGESTTMRRLIDTYQFMKPLQEFAASGKPVFGTCAGLIILAKNIAGTNDAHLGVLDVTVERNSFGRQVDSFEADLTVKGLEGPFTGVFIRAPHILEAGADVEVLSEHNGRIVAAKQGNLLGCSFHPELTDDHRMTKLFVEMVEKHKREAVV

SEQ ID NO: 4211 - protein, 425 aa, Bacillus licheniformis
MLDVKLLRANFEEIKQKLAHRGEDLSDFDQFEELDTKRRELIVKVEELKGKRNEVSQQVAALKREKKDADHLIKEMREVGEDIKKLDEELRTVESSLDKIMLSIPNIPHESVPVGETEDDNVEVRKWGELPEFSFEPKPHWDIADQLDILDFERAGKVTGSRFVFYKGLGARLERALYNFMLDLHVDEYGYTEVIPPYMVNRASMTGTGQLPKFEEDAFKIREEDYFLIPTAEVPITNLHRDEILSADELPINYAAFSACFRSEAGSAGRDTRGLIRQHQFNKVELVKFVKPEDSYEELEKLTNQAEKVLQLLELPYRVMSMCTGDLGFTAAKKYDIEVWIPSQNTYREISSCSNFEAFQARRANIRFRREAKGKPEHVHTLNGSGLAVGRTVAALLENYQQEDGSVIIPKALRPYMGNRDVIQP

SEQ ID NO: 4212 - protein, 376 aa, Bacillus licheniformis
MKIVIAPDSFKESMTSLEAARSIEKGFKEILPDAEYVNIPVADGGEGTVQALVDATGGDIVYQTVTGPLGKPVKAAYGLLGDGKTAVIEMAEASGLHLVPPEQRNPLLTTTRGTGELILDAAEKGVSQIIIGLGGSATNDGGAGMASALGVKFLNRAGEEIENGGGALAEIAKIDVSGLDPKLKHIQFEAACDVDNPLTGPRGASAVFGPQKGANSEMTAHLDQNLKHYAAAVKAELGCEIDSLPGAGAAGGLGAGLCAFLKAELKSGVDIVLDTLSFSERIKGADLVITGEGKIDGQTVSGKTPAGVAKRACSENIPVIAFAGSLGEGCELVYDIGISALFSIVPGISSLENALADGSSNLTRCARNVAAVWSLE

SEQ ID NO: 4213 - protein, 422 aa, Bacillus licheniformis
MDIQINAIGALCALVISIFLILKKVPPAYGMMIGALAGGLIGGADLIETTDLMIAGAKNMIPAVLRILAAGVLAGVLIQSGSAAVIAETIVNQIGEKRALLALTLATAILTTVGVFVDVAVITVAPIALAIARRTFISKAAILLAMIGGGKAGNIMSPNPNAIAASDAFHVPLTSVMAAGIIPAIFGLGATYLLAKRLSNKGTKVAANEIETQTAQQLPAFWAAVSGPVVSILLLALRPAAGITIDPIIALPAGGLVTAIASGQAGKLRDFAASGLSKMSGVAVMLLGTGTLAGIIANSKLNSLITDTLVGLGLPSFLLAPISGMLMSMATASTTAGTAVASSVFGPTLLDLGVAGLAGAAMIHAGATVLDHLPHGSFFHTTGGSVFMAMKERLKLIPYESVIGLILTIISTLIFGIFQFFI

SEQ ID NO: 4214 - protein, 372 aa, Bacillus licheniformis
MNYLSKELAEEIVERTMSIIRHNINMMDENGVIIASGDRSRIGDEHAGAKDALAAEKVISITPEECSALTGTKPGVNLPIVFHDEIIGVIGITGPPSEVSRYGELVKMAAELTVEQAFLTKQLTWDQRLREETVIQMIQGTDLASLDFFERAERLNIPLDGQRTCLVFELPSADMKPAFIKKLEKHLTAKDLYANISLKEVAVILAGAPTKSRSDLFSAWNGWLSQWKTVRGALGEQADQLQQLPFSYQSAKQTLKIAENNCSLYDYREFAIPVLLSKIEHPDQEIHFQNIWDRLSQADQKGELTHTLLCYIEENGEIGETSSRLFIHRNTLNYRLRKIELATGCNPKRFDDLFKLYTAITLFSPFCANEQF

SEQ ID NO: 4215 - protein, 140 aa, Bacillus licheniformis
MWKHFISRLPQDYTLNRPIETGKLQKAEELLGVSFPDELVSLLKMTNGINDTFGDHLIWPADRIIEENLDMRCTDCFKPFDCLLFIAGAGNGDLFAYSILNGSIRKNDIYVWNHIDDSRIWVAPSLKSFIKGWIDGTITI

SEQ ID NO: 4216 - protein, 213 aa, Bacillus licheniformis
MSVYDIPKDAIITVAGTVGVGKSTLTKELAKRLGFKTSLEEVVNNPYLEAFYQDFERWSFHLQIFFLAERFKEQKYIYESGGGFVQDRSIYEDTGIFAKMHADKGTMSKVDYKTYTSLFEAMVMTPYFPRPDVLVYLEGDLETILDRIQKRGREMELLTDRSYWEEMYTRYENWISGFNACPVVRVNIDEYDLFNNSASLDPIIEKISEAIQR

SEQ ID NO: 4217 - protein, 207 aa, Bacillus licheniformis
MNTAPFIAVEGPIGAGKTTLASMLSEKLSLSLVKEIVEENPFLDKFYDEKDEWSFQLEMFFLCNRYKQLEDTEKKYLHHHMPVVSDYHIYKNLIFAERTLEGKKLEKYRKIYQLLTEDLPKPNVIIYIRASLPTLLERIKKRGRPFEQEMDKQYLEQLINDYEAAIKQFKESDPPIPVIEINGDQEDFVISEAVFNRIADQVKEYIE

SEQ ID NO: 4218 - protein, 439 aa, Bacillus licheniformis
MRKEAFPIQIYVVKRGDTLYQIANRYRTTVNEIVATNEIPNPNRLVVGQTIVIPIAGEFYEVRQGDTLASIGARFNISPAELARINRIQVSAVLPVGLLLYIPPRPRRNIETNAYIEPRGESVSPALQQAAREASPYLTYLGAFSFQAKRDGTLEEPPLNNLKEIADRHRTTMMMIVTNLENEAFSDELGRIILTDQNVKNRLLDNIVAAARRYGFKDIHFDFEYLRPEDREAYNQFLRDARARFRQEGWLISTALAPKTRADQPGQWYEAHDYRAHGEIVDFVVLMTYEWGYSGGPPMAVSPIGPVRDVIEYALTEMPASKIVMGQNLYGYDWTLPYTPGGPLARAISPQRAIEIASENNAAIQYDETAQAPNFRYTDNAGKQHEVWFEDARSIQAKFDLIRELNLRGISYWKLGLSFPQNWLLIADQFNVVKETFPS

SEQ ID NO: 4219 - protein, 180 aa, Bacillus licheniformis
MSNSALIIVDIINDFQFDMGNVLSKKTRNITEHLLALKEHAAKMKWPIIYINDHFGIWQADIAAIIKKCKNGRSEYIIDRLAPNDSDYFLIKPKHSAFYGTALETLLHELHVDHLIITGIAGNICVLFTANDAYMREYEITIPRDCIASNNEKDNKYALTMMENVLFANITTAKAITSET

SEQ ID NO: 4220 - protein, 196 aa, Bacillus licheniformis
MRAELDNAIVSFQILYSFNYKLAYSVWRKTLKECMRMTQDEFYMKEAVNEARKAEEKGEVPIGAVLVLDGEIIARAHNLRETEQRSVAHAEMLVIEEACRKLGTWRLERAVLYVTLEPCPMCAGAAVLSRIDKKVFGASDPKGGCAGTLMNLLQEERFNHQAEVVSGVMEEECGRMLSDFFRKLRAKKKAEKQSEL

SEQ ID NO: 4221 - protein, 537 aa, Bacillus licheniformis
MPFYKRNFRTLICFPDRGEREKQAPQKLFAKAVNCERAPVSEPCNECSACKGITNGSISDVIEIDAASNNGVDEIRDIRDKVKFAPSAVTYKVYIIDEVHMLSIGAFNALLKTLEEPPEHCIFILATTEPHKIPLTIISRCQRFDFKRITSQAIVGRMKKIVEAEQLKVQDGALDIIASAADGGMRDALSLLDQAVSFSGEELTVDDALLITGAVSQHYIGKLASTLHEKNVSGALETLNELLQQGKDPAKLIEDMIFYFRDMLLYQTAPDLEGVLEKVKVDEEFQTLSRQIPASDLYEMIDILNKSHQEMKWTNHPRIFFEVAVVKLCLGPKAGASAAAQPEVDNLVNKVRQLEQEIERLKTQGVQVSSAPAQAKEASRPQKSIKSAYKAPVGRIHEILKDATRPDLEKLKGCWGQLLAQLKQQNKVSHAALLNDSEPVAASSKAFVLAFKYEIHCKMVAEDNNGVRTNLEQILDGMLGGRIDIVGVPEAQWGKIREEFLQDHQPEDSEANEPKEEDPLVAEAKKLFGAELIEIKE

SEQ ID NO: 4222 - protein, 109 aa, Bacillus licheniformis
MSMRGGMGNMQKMMKQMQKMQKDMQKAQEELAEKVLEGTAGGGMVTVKVNGQKEVIDVIIKEEVVDPEDVEMLQDLVLAATNDALKKVDEVTNETMGKFTKGMNMPGLF

SEQ ID NO: 4223 - protein, 198 aa, Bacillus licheniformis
MQYPEPISKLIDSFMKLPGIGPKTAVRLAFFVLSMKEDVVLDFAKALVNAKRNLTYCSVCGHITDQDPCYICEDTRRDKSVICVVQDPKDVIAMEKMKEYNGLYHVLHGAISPMDGIGPEDIKIPELLKRLQDDQVTEVILATNPNIEGEATAMYISRLLKPSGIKLSRIAHGLPVGGDLEYADEVTLSKALEGRREM

SEQ ID NO: 4224 - protein, 74 aa, Bacillus licheniformis
MGFLRKKKLRKEFDNKLVEQLIHQKEEWNRQKRLIENSLEPSPEVLYELKVAEAKYFFYLREAKKRNLRIGSWK

SEQ ID NO: 4225 - protein, 88 aa, Bacillus licheniformis
MGSVIFIGAIVALVALLFFSKASFKPLRLIGRIAVRFVVGALFLFCVNLFGESVGIHVPINIVTTGVSGLLGVPGVAALIVIKQFIAI

SEQ ID NO: 4226 - protein, 68 aa, Bacillus licheniformis
MEVEWMSKSNHGETCIICEENKTEGIHLYTKFLCSDCEKKIVSTSTSDPEYSDYVKKLKSLRTPPLYS

SEQ ID NO: 4227 - protein, 205 aa, Bacillus licheniformis
MKPILHFMIRATAASALSVLLWFTSFFAFNQTFLLSSAYAAGAWIAVYLGGKWYGTYLFLKENQLTRREYAYIKQNLREAKLKIARLRKALFAVKNIQTIKQNLEILRIVRKIYSITKNEPKRFYQVERFYYQSLDSIVELTEKHAFLASQPKRNANLEVSLSETRMMIDKLAKQLEDDLYDLLKTDIDHLEFELDVAKHSMKKS

SEQ ID NO: 4228 - protein, 397 aa, Bacillus licheniformis
MSEYKPSLHKTGAQLEFDDLLSDPFGQGEAPVSGVEEKLRGQQVNLVDTLSEEKRRQAFQLAEQIDPKNHNSITLYGTQAQSKLLNFSHEMLEHVQKKDVGEIGQVLSDLMKKLEQVSPDELKTEKRNFFSRLFGRVSHSVQEVLSRYQKTGAQIDRISVKLEHSKSALINDNKMLERLYEKNKEYYEALNVYIAAGQLKLEELNHKTIPELKEKSKTEHHHMAVQEVNDMIQFADRLEKRVYDLTLSRQITLQSAPQIRLIQHTNQVLAEKIQSSIMTAIPLWKNQVAIALTLLRQRRAVEAQKQVSATTNELLLKNAEMLKANTIETAKENERGFIDIETLKQVQDNLIGTLEETLKIQEEGRSKRLQAEEEIRAMEDGLKAKLLDMKENQNRRS

SEQ ID NO: 4229 - protein, 480 aa, Bacillus licheniformis
MKTPLYTALVNHAEGHHYSFHVPGHHNGDVFFDEAKTFFETILKVDLTELTGLDDLHEPSGVIKEAQDLVSRLYGAEESFFLVNGSTVGNLAMILAVCQPGDTILVQRNCHKSVFHAIELSGAHPVFLTPEIDEAMAVPTHILYETVEDAISQYPHAKGIVLTYPNYYGHAVDLKPIIEKAHQHDISVLVDEAHGAHFVLGHPFPQSSLKAGADAVVQSAHKTLPAMTMGSYLHLNSGRINRDRLAYYLSVLQSSSPSYPIMASLDIARAYAEDILKTNRTADIEKELINMREVFSQINGADIVEPADARIRQDPLKLCIRSAYGHSGFELKSIFEANGIHPELADERQVLLILPLEGKNMPAPELISTISKDMKDTAVRNDLPAGIGIPSEKVTALPYRKSKLSAFKKESVPFTEAAGRISAESVTPYPPGIPLIMAGERITKETISRLTRLVDLNVHIQGSNQLKQKQLTVYIEEEKS

SEQ ID NO: 4230 - protein, 212 aa, Bacillus licheniformis
MNGLFITFEGPEGAGKTTILQAAADQLTKNGHSVLATREPGGIEISERIREVILNPSHTAMDPKTEALLYAAARRQHLVEKVKPALEEGKIVLCDRFIDSSLAYQGYARGLGIDEVFSVNQFAIGSLMPNVTIYFDIDPEEGIKRIDLNDAREKNRLDLEKLHFHQLVQKGYEEVMNRFPGRFRIVDASQSVELVLKRVNNIIEEALKENQL

SEQ ID NO: 4231 - protein, 109 aa, Bacillus licheniformis
MKLIIAVVQDQDSNRLLKALTDHNFRVTKLASTGGFLKSGNTTFMLGVDDIRVDKALSLIKENGSKRDQLIAPVSPMGGNADSYVPYPVEVEVGGATVFVLPIEQFHQF

SEQ ID NO: 4232 - protein, 102 aa, Bacillus licheniformis
MKISQELRTMIEKQQTPPARGENVSASFKEKMNIQSGKLRVEQLTMLLTDIEAFGKRLSKSRNFKDLARFKGLIKRFVKETDENVWTVEIQEASICTETAGH

SEQ ID NO: 4233 - protein, 329 aa, Bacillus licheniformis
MATTWTEMQKLQPRVMKLLQNSIERNRLAHAYLFEGRKGTGKLDAATLLAKSFFCLEDGAEPCESCRNCQRIESGNHPDVHVVHPDGLSIKKGQIQALQEEFSKTGLESHKKLYIISHADQMTVNAANSLLKFLEEPSSDTIAVLLTEQPQKLLDTIISRCQVLSFQSLQPESIEKELVKQEVSPNIAALLSNMTNNLSEALELSRNDQFAESRAKVIKLYEVLHQRKGHAFFYIQDQWMPFFKEKDHQEMGLDMLLFIYRDVLSIQLGHEDKILFQDLFQSLKQHALQTTQQRVTNQILAVLEAKKRLYSNVNAQGLMEHLVLMLQEG

SEQ ID NO: 4234 - protein, 275 aa, Bacillus licheniformis
MYNVIGVRFKKAGKIYYFDPNGFQIDKDSCVIVETVRGVEYGQVVIANKKVDENDVVLPLRKVIRVADERDRLIVEENQEAALSAFDVCQKKVNEHGLEMKLVDVEFTFDRNKVIFYFTADGRVDFRELVKDLASIFKTRIELRQIGVRDEAKMLGGIGPCGRMLCCSTFLGDFEPVSIKMAKDQNLSLNPTKISGLCGRLMCCLKYENDEYETAKEQLPDIGEVIATSSGPAKVVGLNILERILQVELTDCDKVVEYTWDELLQEGVVSAQTTD

SEQ ID NO: 4235 - protein, 120 aa, Bacillus licheniformis
MDKKELFDTVISLEEQIGSLYRQLGDLKQHIGEMIEENNHLQLENEHLRKRLEETDQRLKSVKSDEKEIKAEKTGHADIGEGHDNLARLYQEGFHICNIHYGSVRKEGDCLFCLSFLNKK

SEQ ID NO: 4236 - protein, 247 aa, Bacillus licheniformis
MIQLKDDERLDYLLAEDMKIVQSPTVFAFSLDAVLLSKFAYVPIQKGNIIDLCTGNGIVPLLLSTRTKAAITGVEIQERLYDMALRSVEYNNLQKQIHLIRDDLKNMPQVLGYNKADVVTCNPPYFKTPQKTEQNLNEHLAIARHEIYCTLEDVIRVSSKLLKQGGKLALVHRPGRLLEIFELMKAFQIEPKRVQFVYPKKSKEANTILVEGIKDGRPDLKILPPLFVYDEQDQYTHEIRKILYGDE

SEQ ID NO: 4237 - protein, 97 aa, Bacillus licheniformis
METNSHYFYVLSCRDGSLYAGYTNNIEKRLKTHNDGKGAKYTRARLPVKLHYAECFSTKREAMQAEYYFKKLSRKNKERYIEEKRREGVDYQPAKEF

SEQ ID NO: 4238 - protein, 276 aa, Bacillus licheniformis
MLYLVPTPIGNLEDMTFRAVSVLKEADIIAAEDTRQTKKLCHVYEIETQLVSYHEHNKESSGHKILEWLKEGKNVALVSDAGMPTISDPGAEIVRDFIEMGGYVVPLPGANAALTALIASGIAPQPFFFFGFLDRSKRERKKQLEALKNRQETMIFYESPHRLKETLAAIREVFGNRQIALTRELTKKFEEFIRGSIEEALTWSEQEQVRGEFCLVIEGSREETIEEAVWWEHLSEKEHVEHYISEGYPSKEAIKKTAVDRGVPKRKIYDAYHIQN

SEQ ID NO: 4239 - protein, 94 aa, Bacillus licheniformis
MKSTGIVRKVDELGRVVIPIELRRTLGIAEKDALEIYVDDEKIILKKYKPNMTCQVTGEVSDDNLKLAGGKLVLSPEGAEQIINEIQAQLQSQK

SEQ ID NO: 4240 - protein, 662 aa, Bacillus licheniformis
MPQEKNTFYITTPIYYPSGKLHIGHAYTTVAGDAMARYKRLRGFDVRYLTGTDEHGQKIQQTAEKENITPQELVDRAAEDIQQLWKKLDISNDDFIRTTEERHKKVIEKVFQKLLDNGDIYLDEYEGWYSIPDETFYTETQLVDVERNEKGEVIGGKSPDSGHPVELIKEESYFFRMGKYADRLLAFYEENPEFIQPESRKNEMINNFIKPGLEDLAVSRTTFDWGIKVPGNPKHVIYVWIDALFNYITALGFNTENDENYQKYWPADVHLVGKEIVRFHTIYWPIMLMALDLPLPKKVFAHGWLLMKDGKMSKSKGNVVDPVTLIDRYGLDALRYYLLREVPFGSDGVFTPEGFVERINYDLANDLGNLLNRTVAMVNKYFDGRIQSYEGPVTAFDEPLSSFSQKTIEAYEQAIENMEFSVALSSLWQFVSRTNKYIDETAPWVLAKDKDKEKELQSVMYHLAESLRITAVLLQPFLTQTPEKIFAQLGVTDASLKTWDSIQSFGQLKSVTVQKGEPLFPRLEAEDEVAYIKSKMQGTAPKEEPKQEEKAHERLPEITIDDFMSTELRVAEVIHAEPVKKADRLLKLQLDLGFEKRQVVSGIAKHYKPEELVGRKVICVTNLKPVKLRGELSQGMILAGEDNGVLSLAAVDSSLANGTRIK

SEQ ID NO: 4241 - protein, 255 aa, Bacillus licheniformis
MLFDTHAHLNAEQFNEDLEEVIARAKEEKVEHIVVVGFDRPTIKRAMELIEEYDFIYAAIGWHPVDAIDMTDEDLAWIKDLSAHEKVVAIGEMGLDYHWDKSPKDVQKEVFRKQIALAKEVGLPIVIHNRDATEDVVSILREEGAEEVGGIMHCYTGSAEIAQECIDMNFYLSFGGPVTFKNAKKPKEVVKQIPNDRLLIETDCPYLTPHPYRGKRNEPSYVKLVAEQIAELKGMTYEEIAAVTTENAKKLFGIS

SEQ ID NO: 4242 - protein, 398 aa, Bacillus licheniformis
MKKLFSVKLSKSRWILIAAGLLVAGSGTAYGAHELAKQQVTISINGKKQDVRTNAKTVGELLKSLDIETRKEDHISPAEDTKLTANMNVEYVAAKPVHFTVDGQEKEIWTTAGTVGKLLKDLNLELAEHDQIDPSVDKEITKDMKLTLQRAFKVTVKDAGKDKDLWTTSTTVADFLKHHKISIKGDDEVKPALDKKLTKDQAIHITRIKKVTDVVEENIPFEVRKKEDDSLEKGKEKVVQDGKHGKLKKHYAVVMKNGKEVSRELIKEETAAESKAKIIAVGTKQAAVAKVSANVSRGNQSSGKEFYVSSTAYTASCNGCSGHTATGVNLKNNPGAKVIAVDPSVIPLGSKVHVEGYGYAVAADTGSAIKGRKIDVFFPNKSTAYRWGNKRVKIKVLN

SEQ ID NO: 4243 - protein, 186 aa, Bacillus licheniformis
MKIKEIIVVEGRDDTAKIKSAVDADTIETNGSAIGEDVIKRIRLAQETRGVIILTDPDFPGEKIRKTIAEKVPGCKHAFLPKHLAKPKNKRGIGVEHASLEAIRECLMTVQEEMEATEPEIEARDLIEAGLIGGPLAKQRRERLGEILNIGYTNGKQLQKRLQMFQIKKSDYLSALDAVLREEEHE

SEQ ID NO: 4244 - protein, 292 aa, Bacillus licheniformis
MNKDIATPIRTKEILNKYGFSFKKSLGQNFLIDTNILDRIVDHAGVTERTGVIEIGPGIGALTEQLAKRAKKVTAFEIDQRLLPILEDTLSPYDNVTVIHQDVLKADVRAVMDEQFQDCDEVMVVANLPYYVTTPIIMKLLEENLPLKGIVVMLQKEVADRMAAKPSSKEYGSLSIAVQFYTEAKTVMNVPKTVFVPQPNVDSAVIRLTLRKEPAVAVQDAAFFFQVVKASFAQRRKTLFNNLVNNLPNGKENKSKIERALQDSHIDGKRRGESLSIEEFAVLSDRLREVLL

SEQ ID NO: 4245 - protein, 299 aa, Bacillus licheniformis
MCGVKSMQFKIGDMVVRKSYRRDILFRIIRIDQSANGEPVAVLHGDEVRLIADAHLGDLEIVREAEWQMRKREEETRMKESLDLLRQDYKLLHDKHEYRATNQYNNQQQYFHMPGRVLHLDGDSAYLKKCLALYEKIGVPVYGIHCYEKKMSSVIEELIDEYRPDLLVITGHDAYSKQKGDINNLDAYRHSKDFIETVQKARRKIPHLDQLVIFAGACQSHFESLIRAGANFASSPSRVNIHALDPVYIVAKISFTPFMDRINVWEVLRNTLTREKGLGGIETRGVLRIGMPYKTKAND

SEQ ID NO: 4246 - protein, 86 aa, Bacillus licheniformis
MAKTLSDIKRSLDGHLGKRLTLKANGGRRKTIERSGILAETYPSVFVIQLDQDENSFERVSYSYADILTETVELRFSDDKTSSVAL

SEQ ID NO: 4247 - protein, 61 aa, Bacillus licheniformis
MGRRRSIMSEEFKNELAKDLGFYDTVKTEGWGGIRARDAGNMVKRAIELAEQHMAQNQQNH

SEQ ID NO: 4248 - protein, 292 aa, Bacillus licheniformis
MNGLRILEKAPAKINLSLDVRHKRPDGYHEVEMVMTTIDLADRVELTELAEDKVTVSSHNRFVPDDQRNLAYQAAMLMKERYGIKKGVSIFITKVIPVAAGLAGGSSDAAAVFRGLNRLWDLKLSMNELAELGAEIGSDVSFCVHGGTALATGRGEKIRHIETPPHCWVVLAKPTIGVSTAEVYKQLKVDEIEHPDVQGMIAAIEEKNFQKMCDKLGNVLESVTLNMHPEVAMIKNQMKRFGADAVLMSGSGPTVFGLVQYESKVQRIYNGLRGFCDQVYAVRMIGEQNELD

SEQ ID NO: 4249 - protein, 277 aa, Bacillus licheniformis
MKFRRSGRLVDLTNYLLTHPHVLVPLTFFSERYQSAKSSISEDLTIIKQTFEQQGIGTLQTVPGAAGGVKYIPKVKRDEAEEFVKSLGESLIDSERILPGGYLYLTDILGKPSVLTKAGKIFASAFSDREIDVVMTVATKGIPLAYAVASYLDVPTVVVRKDNKVTEGSTVSINYVSGSSNRIQTMSLAKRSLQTGSHVLIIDDFMKAGGTINGMINLLDEFNAHVAGIGVLVEAQGVKERLVDEYMSLLTLSEIDMKEKKVEIQNGNFQRFFAENE

SEQ ID NO: 4250 - protein, 125 aa, Bacillus licheniformis
MTKVVQTKEAPAAIGPYSQGIVVNNMFYSSGQIPLTPSGEMVTGDITEQTHQVFRNLKAVLKEAGASLETVVKATVFLADMNQFTEVNEVYGQYFDTHKPARSCVEVARLPKDALVEIEVIALVK

SEQ ID NO: 4251 - protein, 97 aa, Bacillus licheniformis
MEVTDVRLRRVNTDGRMRAIASITLDHEFVVHDIRVIDGNNGLFVAMPSKRTPDGEFRDIAHPINSSTRGKIQDAVLNEYHRLGDVEEIEYEEIGAS

SEQ ID NO: 4252 - protein, 456 aa, Bacillus licheniformis
MDKRFAVVLAAGQGTRMKSKLYKVLHPVCGKPMVEHVVDEARKLSLEKLVTIVGHGAEDVKKQLGEKSEYALQAEQLGTAHAVKQAKSILGSEKGTTIVICGDTPLLTAETMEAMLTEHQKKAAKVTILTAVAEDPTGYGRIIRNENGDVAKIVEHKDATEEERLVKEINTGTYCFDNEALFQTIEQVSNDNVQGEYYLPDVIEILKNQGETVAAYQTVNFQETLGVNDRVALSQAEIYMKQRINKRHMQNGVSLIDPDNTYISPEAVIGRDTVIYPGTVIKGRVVIGEDAVIGQNSELENSTVGSRTVIKQSVIVDSEVGDDVTIGPFAHIRPDSKIGNEVRIGNFVEVKKSEFGDRSKASHLSYIGDAEIGTDVNLGCGSITVNYDGKHKFKTKIENGAFIGCNSNLVAPVTIGEGAYVAAGSTITDDVPGRALSIARARQVNKEDYAENIHKK

SEQ ID NO: 4253 - protein, 316 aa, Bacillus licheniformis
MSKYEDDNLKIFSLNSNPGLAKEIADIVGVELGKSSVKRFSDGEVQINIEESIRGCDCYVIQSTSAPVNEHIMELLIMVDALKRASAKTINIVMPYYGYARQDRKARSREPITAKLVANLLETAGATRVIALDLHAPQIQGFFDIPIDHLMGVPILGNYFEEKNFKDIVIVSPDHGGVTRARKLADRLKAPIAIIDKRRPKPNVAEVMNIIGHIEGKTAILIDDIIDTAGTITLAANALVESGAEEVYACCTHPVLSGPAIERIDNSKIKELVVTNSIELPEEKKIAKFKQLSVAPLLAEAIIRVHEKQSVSFLFD

SEQ ID NO: 4254 - protein, 208 aa, Bacillus licheniformis
MAILKAEERTDSRRSSLRRIRQSGYVPGVIYGRNLENKSVALDSIELLKILRAEGKNTIINLDINGDQHSVMVTELQTDPLKDSIVHADFKVVDMEAEMEATVPVNLTGEAEGIKQGGVLQQPLYELSVTAKPKNIPQTIEVDISSLEVNDVLTVGDIPTKGDYSYNHEPDEVVASILPPQKQEETEAESAAQDVEEPEKGTEEEKEE

SEQ ID NO: 4255 - protein, 188 aa, Bacillus licheniformis
MLVFAGLGNPGKTYENTRHNVGFMTIDELSKEWNIPLDKTKFNGQYGIGFVSGKKVLLVKPLTYMNLSGECLRPLLDYYEIPVDNLKVIYDDLDLPTGRIRLRTKGSAGGHNGIKSTIQHLGTSEFNRIRIGIGRPVNGMKVVDYVLGAFTDEEEPAIKEAVRQSAKACEASLEKPFLEVMNEFNAKV

SEQ ID NO: 4256 - protein, 76 aa, Bacillus licheniformis
MALHYYCRHCGVKVGSLDHSYVNSEQLGFNHLTNDERNDMISYMDNGDLHVKTICEDCQEALERNPDYHQYHSFIQ

SEQ ID NO: 4257 - protein, 1177 aa, Bacillus licheniformis
MNNIQSYITKSDDFKSIVNGLNEGLKEQLLAGLSGSARSLFTAALTKETRRPVFLITHNLYQAQKITDDLTGLIKDQPVLLYPVNELISSEIAVASPELRSQRLDVLNRLASGETPIVVAPAAAVRRMLPPVEVWQNSQIHIETGRDIDTEQLLQKLVQMGYERTDMVAAPGEFSIRGGIIDVYSLTEENPVRIELFDTEVDSIRIFNTDDQRSLETRDEVTIGPAKELIVRDEDRQRALEQIDQGLANSLKKLKLDKQKEILDQNIAEDKERLKEGHIGQEMVKYLSYFYEKPASLLDYFPKNTLLILDEISRIHEMEDQLQKEEAEWITSLLEEGKILHDTSMSFPFHSLISKQSRPILYYSLFLRHVQHTSPQNIVNVSSKQMQSFHGQMNVLKNEIERFKKSKYTTVFLGDSKERVEKLASVLSDYDIEAAQADQDAALAQGQIYIMEGGLQSGFELPMIKLAVITEEELFKKRVKKQARKQKLTNAERIKSYSELQIGDYVVHVNHGIGKYLGIETLEINGIHKDYLNIHYQGSDKLYVPVDQIDQVQKYVGSEGKEPKLYKLGGSEWKRVKKKVESSVQDIADDLIKLYAEREASKGYAFSPDHEMQREFEAAFPYQETEDQLRSIHEIKRDMEKERPMDRLLCGDVGYGKTEVAIRAAFKAIADGKQVAILVPTTILAQQHYETILERFQDYPINIGLLSRFRTRKEANETIKGLKNGTVDIVIGTHRLLSKDVVYKDLGLLIIDEEQRFGVTHKEKIKRIKANVDVLTLTATPIPRTLHMSMLGVRDLSVIETPPENRFPVQTYVVEYNGALVREAIERELARGGQVYFLYNRVEDIERKAEEISMLVPDAKVTYAHGKMTENELESVMLNFLEGESDVLVSTTIIETGVDIPNVNTLIVFDADKMGLSQLYQLRGRVGRSNRVAYAYFTYRKDKVLTEVAEKRLQAIKEFTELGSGFKIAMRDLTIRGAGNLLGAQQHGFIDSVGFDLYSQMLKEAIEARKGDAPQAEKFEPEIDLELDAYIPQTYVTDGKQKIDMYKRFRAISTIEEKSELQDEMIDRFGEYPKEVEYLFAIAEAKVYAIKERVELIKQDKDAVRLTIDEKASAEIDGQKLFELGSKYGRQIGLGMEGKKLKISIQVKNRKPEEWLETLLDILKGLQNVKKQTIASS

SEQ ID NO: 4258 - protein, 178 aa, Bacillus licheniformis
MKATGIVRRIDDLGRVVIPKEIRRTLRIREGDPLEIFVDRDGEVILKKYSPISELGDFAKEYADALYDSMGHSVLICDRDVYIAVSGGSKKDYLNKSISDMVEKAMDQRTSVLDGDAKTIQLIDGIDEEVASYTVGPIVANGDPIGAVVIFSKDQSIGEVEHKAVETAAGFLARQMEQ

SEQ ID NO: 4259 - protein, 530 aa, Bacillus licheniformis
MGFLKGQRQLLWQGAFVLSLAGILSKILSAVYRVPFQNIVGDVGFYIFQQVYPMIGISVMLATSGFPVIISKLLNDYGSANRAKILRVSMLFLSAVGLGFFLLLFAGAGAIAGFMGDPDLAGVIRAVSFSYLLLPFVSLLRGYFQGSERMLPTALSQIGEQTLRVGAILVLTWWLVKSGFSLYDAGAGAAFGSLVGGLAAFFILAVFWAKREKKATAARMEAGTGDILKQLCLYSVTICTAGLMLILIQLVDALHLYSLLAGQGMGELQAKHTKGVYDRGQPLLQLGTVFAASIATALVPSLTKAKKKGETAVLEEKIRYSLKMSFVIGTGAAAGLICILEPVNVMLFKNSDGTAALQIFSASILFASLAMTMTAVLQGLGNTCLPAVSVCCGFLVKAVLNELLIPGFGISGAAFATMMSFAAVAGLNFFQLKRKGWIKLSEYRIAGVLLSAVIMSAALAVWLFAFEAAIPHKSRWISAAESLSAVFVGGVVFLSGIFTLRVFSEKELELVPFGSKLLTLKRERGGRHGR

SEQ ID NO: 4260 - protein, 489 aa, Bacillus licheniformis
MAGKITVVGLGAGDMNQLTLGVYKRLTQAEVLYVRTKDHPLIEDLKKEIAEIHFFDEVYEKHDQFEDVYEEIVERLFEEAKQGDVLYAVPGHPFVAEKTVQLLLERRGAHQADVVVEGGHSFIDATLNALQIDPIDGFQFVDAVRFSADEVELRHHLIICQVYDQMTASEVKLTLMEKLPDDYEVVIVTAAGSSMQDIRTVPLYELDRSVGINNLTSVYVPPVKDEEILHQEFSMFRSVIRKLRGPDGCPWDRKQTHESLKKYLIEECYEVLEAIDEEDPDHLVEELGDVMLQVLLHAQIGEDDGLFTIDDVIRGITAKMIRRHPHVFGEVSVRDEADVMVNWEEIKKQEKQADDKSLLDDIPKPLPALSKANKLQKKAAKTGFDWSNVQDIWDKVQEEMKEFSSEISEAEQHSKKMKEEFGDLLFALVNIGRFYKIEPEEALAMTNAKFYRRFTYIEQSAKRMGKDLESMTLEEMDELWNEAKGIERS

SEQ ID NO: 4261 - protein, 87 aa, Bacillus licheniformis
MRLDKFLKVSRLIKRRTLAKEVADQGRISINGQQAKASSVVKAGDELAVRFGQKLVTVKVNELKDTTKKEEAADMYTVLKEEKLGGE

SEQ ID NO: 4262 - protein, 102 aa, Bacillus licheniformis
MNVYYDQHNPSGGASGPEHNVTMKGRKLLDISGVKQVESFDNEEFLLETVMGMLAVRGENLQMKNLDVEKGVVSIKGRVLDLVYLDEQQGEKAKGFFSKLFK

SEQ ID NO: 4263 - protein, 208 aa, Bacillus licheniformis
MTLTTQFYTMLAMAGMGAWLGASLDTYTRFVVRSKTARWLLFLHDFLFWVVQGLLFFYVLLSVNEGEFRIYIFLAVMLGFAAYQSLFKQVYIKLLEWMISFFIFISRLVSKMMRMMVFRPVVWTFQAILAIILFTMRNIYVLFRFFAVCLYKILKFAGYPIYFILYQCCRLLPAPVRGLLRRFLQKGAGFFEKGKKLFITIKAKLLKK

SEQ ID NO: 4264 - protein, 125 aa, Bacillus licheniformis
MNDPTRRNISQIQNEYKEQMERKQQQLKRKRRGLYRRLMVFGAVVLLSAIVIVSSLWSQTSDISAKQEKKAELLKQLEQLEAKKSDLKDEIVKLKDEDYVAELARKDYYLSKDGEIIFKFEDKSK

SEQ ID NO: 4265 - protein, 132 aa, Bacillus licheniformis
MSIEVGSKLQGKVTGITNFGAFVELPGGSTGLVHISEVADNYVKDINDHLKVGDQVEVKVINVEKDGKIGLSIKKAVDRPQSSRPARPKNDFRSKETFEQKMNKFLKDSEDRLSSLKRNTESKRGGRGARRG

SEQ ID NO: 4266 - protein, 829 aa, Bacillus licheniformis
MEKAERRVNSPIAGPAVQKLYSWFGSMTKLMMQHLYSLFFYKGLIYMVIGFLLGRAFILSEVIPFALPFFGAMLLIKKDKAFLACLALLAGALSISPQHSLFVLAALFAFAICSKMTSLIIKDRVRTLPVVVFLAMAVTRCGFVYAEYGTVSGYHYIMAFVEAGLSFILTLIFLQSLPIVTSKRAKQSLKIEEIICFMILIASVLTGLTGVSFQGMQAELILARYVVLAFAFIGGASIGCTVGVVTGLILSLSNIGNLYQMSLLAFSGLLGGLLKEGKKFGAAVGLLIGSLLISLYGEGSAELVPTLYESLIAIGLFLLTPQSITKKVAKYIPGTTEHAQEQQQYARKIRDVTAQKVDQFSNVFHALSESFATFYHSAPDDEGKEKEIDLFLSTVTEHSCQSCYKKNKCWVQNFDKTYDLMKRVMQETEEKQYFKNRKLKKEFHQHCSKSKQVEALIEDELTHFRANQTLKQKVHDSRRLVAEQLLGVSQVMADFSREIKREREQHFIQEEQIRDALQHFGIEIQQVEIYSLEQGNIDIEMSIPYCNGHGECEKIIAPMLSDILEEQIIVKAEQCAGHPNGYCHVAFGSAKSYRVVTGAAHAAKGGGLVSGDSYNMMELGTGKYAAAISDGMGNGARAHFESNETIKLLEKILQSGIDEKVAIKTINSILSLRTTDEIYSTLDLSVIDLQDASCKFLKIGSTPSFIKRGDQIIKVQASNLPIGIITEFDVDVVSEQLKAGDLLIMMSDGIFEGPRHVENHDLWMKRKLKSLKTEEPQEIADLIMEEVIRTRSGLIEDDMTVIVIKLDHNTPKWASIPAPAFFQKNQEIS

SEQ ID NO: 4267 - protein, 245 aa, Bacillus licheniformis
MKKGHLNQILLLTDGCSNRGEDPQAMAAFAKEQGITVNVIGIMDEHEMDQEAMKEVEGIALAGGGVHQVVYTSQLSQTVQMVTKKAMTQTLQGVVNSELKQILGKHTEMDELPPDKRGEVMEVVDELGETVHLHVLVLVDTSASMNPKLPTVKEALIDLSISLNSRIGENEFAMLIFPGKKQEVELVLDWTPKFESLSSIFSKLSAGGITPTGPAIREAIQHFNKIGSRRRMLEDDEKRFDEFGG

SEQ ID NO: 4268 - protein, 344 aa, Bacillus licheniformis
MKNASTSLAASLKPGAAVVGKWNNHSYKIIRQLGKGANGVVYLADSRKGRVALKVSDDSLSITSEVNVLKSFSKAQAKAMGPSFFDVDDMMVTGTGKKLSFYVMEYIEGPLLLRYVNEKGEEWTPVLISQLLSSLSAIHREGWVFGDLKPENLIVTGPPPQIRCIDVGGTTKEGRAIKEYTEFFDRGYWEFGTRKAEPSYDLFSVAMIMVNCAVKKEFKKTARPQEQLMSVIDGHPFLKRYKPVLASALKGSYRTADEMKGDLLEIGRPPRMQSSRQSRTARSSSASAPSQGLRHKRGTPQQQRLRSGRRKQRNPSKSGGVFETLLIVVSVLALYFAYIVLFFI

SEQ ID NO: 4269 - protein, 476 aa, Bacillus licheniformis
MKSIEDFMKKYELSFDGVTLIAGVSGGPDSMALLHALHHTVPASATLIAAHVDHMFRGEESERDMRFVQDYCEAEGIQCEAVQIDVLAFAAENNLNKQAAARECRYAFFQELMKRHRAEYLVLGHHGDDQVETMLMKMAKGTVGIGLAGIQPKRRFDSGWLLRPFLKLSKDDLLAYCKENRIPFRTDPSNSEDDYTRNRFRHHVLPFLKKESEDVHKRFQSVSEFLTEDELYLQALTKDKMNTVITSKSSSGVEISIERLLALPMPLQRRGVHLILNYLYENVPSAFSAHHIQVFLDWISQDGPSGSLDFPNGLKVAKSYHTCLFTFQRLQCENVSYHYEISGAGEEELILPGGSSLHVSGPGSTRKLQGNDVFATSPKQVQFPLYVRTRQNGDRVKLKGMNGSKKVKDIFIDEKVPLSKRDSWPIVTDAVGNIIWIPGLKKTIFEELDVTNNDRIVLQYRQHEKCRGLAKNETGY

SEQ ID NO: 4270 - protein, 179 aa, Bacillus licheniformis
MKQDIENILISEEEIQKKVKELGATLTEEYSGKFPLAIGVLKGAMPFMADLLKHIDTYLEMDFMDVSSYGSSTVSSGEVKIIKDLDTSVEGRDILIIEDIIDSGLTLSYLVELFRYRKAKSIKIVTLLDKPSGRKADIKADYVGFEVPDAFVVGYGLDYAERYRNLPYIGVLKPAVYES

SEQ ID NO: 4271 - protein, 639 aa, Bacillus licheniformis
MNRVFRNTIFYLLILLVVIGVVSYFQTANPKTENMTYSDFVSNLENGKVENVSIQPVRGVYEVRGQLTTYEKDQYFLTHVPEGKGADQIIDQVKKTKIQIEPAQEANGWMTFFTTIIPFVIIFILFFFLLNQAQGGGSRVMNFGKSKAKLYTEEKKRVKFKDVAGADEEKQELVEVVDFLKDPRKFAELGARIPKGVLLVGPPGTGKTLLAKACAGEAGVPFFSISGSDFVEMFVGVGASRVRDLFENAKKNAPCLIFIDEIDAVGRQRGAGLGGGHDEREQTLNQLLVEMDGFSANEGIIIIAATNRADILDPALLRPGRFDRQITVDRPDVKGREAVLQVHARNKPLDESVNLKAIAMRTPGFSGADLENLLNEAALVAARQDKKKIDMRDIDEATDRVIAGPAKKSRVISKKERNIVAYHEAGHTVIGLVLDEADMVHKVTIVPRGQAGGYAVMLPKEDRYFQTKPELLDKIVGLLGGRVAEEIIFGEVSTGAHNDFQRATGIARRMVTEFGMSEKLGPLQFGQSQGGQVFLGRDFNNDQNYSDAIAYEIDKEIQRFIKECYERAKTILTENRDKLELIAQTLLEVETLDAEQIKHLSEHGRLPDRTYSDDQEKTDDVKVNINKRDDEEKNEDEKE

SEQ ID NO: 4272 - protein, 262 aa, Bacillus licheniformis
MVIRMLLVIDVGNTNTVLGIYHEGELEYHWRIETSRHKTEDEFGMLLRSLFDYVGLMFDQIEGIIISSVVPPIMFSLERMCIKYFQIEPQIVGPGMKTGLNIKYDNPKEVGADRIVNAVAAIHLYGSPLIVVDFGTATTYCYINERKEYMGGAIAPGITISTEALYSRAAKLPRIEIARPDHIVGKSTVSAMQSGILYGYVGQVEGIVKRMKWQSKKNPKVIATGGLASLIADESDCIDIVDPFLTLKGLELIYERNRVESV

SEQ ID NO: 4273 - protein, 289 aa, Bacillus licheniformis
MDYLVKAIAYDGKVRAYAANTTETIHEAQRRHNTWPTASAALGRTMTAAVMLGAMLKGEDKLTVKIEGGGPIGAIVADGNAKGDVRGYVSNPHVHFDLNEHGKLDVRRAVGTSGTLSVVKDLGLRDLFTGQVEIVSGEIGEDFTYYLVSSEQVPSSVGVGVLVNPDNTILAAGGFILQLLPGTDDETITKLETNLSQVEPISKLIQKGLTPEEVLAAVLGEEPEVLETVPVRFTCNCSKERFARGIIGLGKDEIQQMIDEDGQAEAQCHFCNETYLFTKEELEALRDEI

SEQ ID NO: 4274 - protein, 295 aa, Bacillus licheniformis
MKSRTLWPIILGAIFVNCIVIAYVLTKAQTASSSSAQEVIAHIGKNGITREEWLSEMEERYGKSTLEDMINDRVVTQMPKKTRSKCLMMHEREFLLIKAVYNSFSEDENTTEKEWKEQIKHNILLEELLTKDIVISDSELKSFYNKNKDLYKFDDSYRLKHIVVKDKDEAEQVLKELKEGSSFEAAAAEHSTDRYTAPYGGDLGFVNDQHENVPAEYLEKAEQLKENQWVDEPIKTSQGYAIIQLKEKLPGQAFTYSEVKNQIRRQIAMDQLGDKASVKTLWKDAKLSWFYDDKK

SEQ ID NO: 4275 - protein, 306 aa, Bacillus licheniformis
MVRVANSVYDLIGNTPVVKLNRLVDEDSAEVYVKLEYMNPGSSVKDRIALAMIEDAEEKGLLKEGDTLIEPTSGNTGIGLAMVAAAKGIKAILVMPDTMSSERRNLLRAYGAELVLTPGAEGMKGAIKKAEELAEEHGYFMPQQFNNPANAEVHRRTTGKEIAEQFGDGLDAFIAGIGTGGTITGAGEVLKEKNPSIKIFAVEPTDSPVLSGGKPGPHKIQGIGAGFVPKILNTEIYDEIITVKNEEAFEFARKRRERKEFSEDFFRRSHLCCSSVAKKLGKGKKVLAVLPSNGERYLSTPLYQFE

SEQ ID NO: 4276 - protein, 476 aa, Bacillus licheniformis
MRQRRPVARAFPFSNQQFLQQYESLSKGKEYHVLLESARGGEYSIAGLDPVAIAKGKDGITTIQYKGDVIFKEGDPFLQFSQWFETLKTETVADFPDFQGGAVGFLSYDYARYIEKFKILSIDDLQTPDLFFLVFDDIAVYDHEQQQLWVITHTDEETPAAAEEKLDRLEQMWKTEHPKAAGGHQPNDNKGPAFAASFTEAGFSQAVEKVKQYIASGDVFQVNLSVRQSERLSAPPYEVYKMLREINPSPYMAYLETPDFQIICGSPELLIKKKGTRLETRPIAGTRSRGADEAEDEALANELIMNEKERAEHVMLVDLERNDLGRVSKYGSVRVDEFMVIEKYSHVMHIVSNVCGELRDECDAVDVIHAVFPGGTITGAPKVRTMEIIEELEPTRRGLYTGSIGWFGYNQDMHFNIVIRTIYVKAGQAFMQSGAGIVIDSNPRHEYKESIKKALAMKKALQLSEEEKKEQRRAEI

SEQ ID NO: 4277 - protein, 194 aa, Bacillus licheniformis
MILMIDNYDSFTYNLVQYLGELGEELVVKRNDEITLQEIEDMSPDFLMISPGPCSPDEAGISLEAIRHFAGKIPIFGVCLGHQSIAQVFGGDVVRAERLMHGKTSEISHDGLTVFKGLEHPLTATRYHSLIVKPDTLPDCFETSAWTEEGEIMAIRHKELPVEGVQFHPESIMTAYGKEMLKNFIETYRKKVNA

SEQ ID NO: 4278 - protein, 286 aa, Bacillus licheniformis
MIIYLNGQYVKEEEARLSPFDHGFLYGVGVFETFRLYEGKPFLLDWHMDRLNNALEQLKIELELTKSEVLVILDRLLQLNQPQNLDARVRLNISAGPGGPGLFPDSYKNPGVMVMMNPFQPASVPAEKEGVILQVRRNTPEGPFRLKSHHFLNNLYGKRELGHDAAKEGIFLTEGGAVAEGIISNVFWRKGSCVYTPSLDTGILGGVTRRYVIERLADMGIEVIEGVYPLEELLFADEAWMTNSVQEIVPFRRIGSTEFPGKDGNLSKRLQEAYTNDRKAAKEYLS

SEQ ID NO: 4279 - protein, 285 aa, Bacillus licheniformis
MALQTAVRSKQLIAKQYTLSYEDKTLIMGILNVTPDSFSDGGKYNSIDRAVIHAKQMIEDGAHILDIGGESTRPGAEKVSLDEELSRVIPVIEKLVQEIDVPISVDTYKAQVADEAIKAGAAIINDVWGAKADPDMARVAAAHNVPIILMHNREERNYKDLIPDMLSDLMECVSIAKSAGVQDHHIVLDPGIGFAKTYHDNLAVMNQLEKFSEPGYPVLLGTSRKKFIGRVLDLPPEERAEGTGATVCLGIQKGCDIVRVHDVKQISRMAKMMDAMIDKGGVYHR

SEQ ID NO: 4280 - protein, 127 aa, Bacillus licheniformis
MIKEAFIIDKVHVEGMEFYGYHGVFKEENKLGQRFRVDLTAFLDLSEAGKTDNIEATINYAELYKLCKEVVEGEPVNLVETLAETIAAQVLENFEAVQECTVKVVKPDPPIPGHYKSVAIEMTRKRK

SEQ ID NO: 4281 - protein, 166 aa, Bacillus licheniformis
MNNTAYIALGSNIGRREEYLKKAVSLLHQHPSVEVTDISSIYETDPVGYTDQDLFLNMAAAVKTSLSPFELLDLTQRIEKELGRKRDIRWGPRTADLDILLYNRENIETEQLIVPHPRMHERLFVLIPLLEIYPDLEGAVNHAKNQEGVRVWKQKSGVDEFVHIES

SEQ ID NO: 4282 - protein, 69 aa, Bacillus licheniformis
MEAEIWGRRIRAYRKLKGYTQEGFAKALGISVSVLGEVERGNRMPTESMLRDVANTLNITVEELSPSEE

SEQ ID NO: 4283 - protein, 333 aa, Bacillus licheniformis
MFKIGDIELKNRVVLAPMAGVCNSAFRLTVKEFGAGLVCAEMVSDKAILYNNAKTMGMLYIDEREKPLSLQIFGGEKETLVEAAKFVDQNTTADIIDINMGCPVPKITKCDAGAKWLLDPNKIYEMVSAVVEAVDKPVTVKMRMGWDEDHIFAVENARAVERAGGKAVALHGRTRVQMYEGTANWDIIKEVKQSVSIPVIGNGDVKTPQDAKRMLDETGVDGVMIGRAALGNPWMIYRTVHYLETGELKDEPKVREKISVCKLHLDRLIGLKGENVAVREMRKHAAWYLKGIRGNAKVRNEINHCETRDELVQLLDAFTIEAEAKELQDAKVG

SEQ ID NO: 4284 - protein, 499 aa, Bacillus licheniformis
MSHEEHNHEELNDQLQVRRDKMNQLRESGKDPFGQRFDRTHQSTDLIESYNEFSKEELEEKAIEVTIAGRMMTKRGKGKAGFAHIQDLKGQIQIYVRKDSVGEEQYEWFKSSDLGDIVGVTGVMFKTNVGELSVKATSFDLLTKALRPLPDKYHGLKDIEQRYRQRYLDLIVNPESKNTFITRSKIIQSMRRYLDDHGYLEVETPTMHAIPGGASARPFITHHNALDMPLYMRIAIELHLKRLIVGGLEKVYEIGRVFRNEGVSTRHNPEFTMIELYEAYADYKDIMRLTENLIAHIAQEVLGTTTVQYGDYEVDLKPEWKRLHMVDAVKEATGVDFWKEVSVEEARAYAKEHGIEISEGMSVGHIINEFFEQKVEETLIQPTFIYGHPVEISPLAKKNPEDPRFTDRFELFIVGREHANAFTELNDPIDQKERFEAQLKEREEGNDEAHMMDEDFVEALEYGMPPTGGLGIGIDRLIMLLTNSPSIRDVLLFPQMRHR

SEQ ID NO: 4285 - protein, 154 aa, Bacillus licheniformis
MGKNISDIIEQYLKQILEQNGKEILEIKRSEIADKFQCVPSQINYVINTRFTSERGYIVESKRGGGGYIRIIKIKMNDKIDLINNIMNQIYTRLSQAASDDIILRLLENGVITESEAKLMVSVMDRSVLYIDLPERDELRARMMKAMLTSLKFK

SEQ ID NO: 4286 - protein, 184 aa, Bacillus licheniformis
MICQECKERPATFHFTKVINGEKKEMHICEQCAKENSESYSMNESGGFSIHNLLSGLLNFDSSFTNSSEAQLFQQPDQVLRCKKCNMTFPEFRKTGRFGCSECYKTFHSYITPVLRKVHSGNTVHAGKIPKRIGGNLHVRRQIEALKKELKELIQQEEFEKAANIRDQIRSLEQNLNANKEEED

SEQ ID NO: 4287 - protein, 363 aa, Bacillus licheniformis
MSLQHFIQNALSNWMRQEGPESDIVLSSRIRLARNLDKVRFPTLFSNEEASAIIALFEEQFTGYEVPGIGKFELVKMDQVQPLEKRVLVEKHLISPHLTEASFGACLLSENEEVSIMLNEEDHIRIQCLFPGFQLSEALKAANQVDDWIEDRIDYAFSEQRGYLTSCPTNVGTGLRASVMMHLPALVLTRQINRIIPAINQLGLVVRGIYGEGSEALGNIFQISNQITLGKSEHDIVEDLNSVVAQLIEQERSARKALYQTSQIELEDRVYRSYGVLSNCRMIESKETARCLSDVRLGIDLGIIKGLSSNILNELMILTQPGFLQQYSGGALRPNERDIRRAALIRERLKLENNGNRQEDETI

SEQ ID NO: 4288 - protein, 810 aa, Bacillus licheniformis
MMFGRFTERAQKVLALAQEEALRLGHNNIGTEHILLGLVREGEGIAAKALQALGLSPDKIQKEVESLIGRGQEMSQSIHYTPRAKKVTELAMDEARKLGHSYVGTEHILLGLIREGEGVAARVLNNLGVSLNKARQQVLQLLGSNESGGAASGANSSANTPTLDSLARDLTAIAKEDSLDPVIGRSKEIQRVIEVLSRRTKNNPVLIGEPGVGKTAIAEGLAQQIINNEVPEILRDKRVMTLDMGTVVAGTKYRGEFEDRLKKVMDEIRQAGNIILFIDELHTLIGAGGAEGAIDASNILKPSLARGELQCIGATTLDEYRKYIEKDAALERRFQPIQVDQPSPEESIQILKGLRDRYEAHHRVSITDEAIEAAVKLSDRYISDRFLPDKAIDLIDEAGSKVRLRSFTTPPNLKELEQKLDEVRKEKDAAVQSQEFEKAASLRDTEQRLREQVEETKKTWKEKQGQENSEVTVDDIAMVVSSWTGVPVSKIAQTETDKLLNMESILHSRVIGQDEAVVAVAKAVRRARAGLKDPKRPIGSFIFLGPTGVGKTELARALAESIFGDEEAMIRIDMSEYMEKHSTSRLVGSPPGYVGYDEGGQLTEKVRRKPYSVVLLDEIEKAHPDVFNILLQVLEDGRLTDSKGRTVDFRNTILIMTSNVGASELRRNKYVGFNVQDETQNYKDMKDKVMGELKRAFRPEFINRIDEIIVFHSLEKKHLKDIVSLMSDQLTKRLKEQDLSIELTEAAKEKIADEGVDLEYGARPLRRAIQKHVEDRLSEELLKGHIQKGQHIVLDVEDGEFVVKTEAKTN

SEQ ID NO: 4289 - protein, 427 aa, Bacillus licheniformis
MVEETIKKPAANRRTAFSHSVQTVQKPSPLTSIETTEEPRIKTKLGEFNRVLGNGIVKGSLVLIGGDPGIGKSTLLLQVSAQLADSKENVLYISGEESVKQTKLRADRLGINSPTLHVLSETDMEYITSSIEEMNPSFVVVDSIQTVYQSDITSAPGSVSQVRECTAELMRIAKTKGIPIFIVGHVTKEGSIAGPRLLEHMVDTVLYFEGERHHTFRILRAVKNRFGSTNEMGIFEMREEGLTEVLNPSEIFLEERSAGAAGSSVVASMEGTRPVLVEIQALISPTSFGNPRRMATGIDHNRVSLLMAVLEKRVGLLLQNQDAYLKVAGGVKLDEPAIDLAVAVSIASSFRDTPPHPTDCFIGEVGLTGEVRRVSRIEQRVQEAAKLGFKRMIIPSANVEGWTKPKGIEVVGVENVAEALRASLGGS

SEQ ID NO: 4290 - protein, 358 aa, Bacillus licheniformis
MDKDKKGAKQDLSEILQFVAPGTPLREGIENVLRAKTGGLIVVGFNDKVKEVVDGGFHINSSFSPAHLYELAKMDGAIILSDSGQKILYANTQLMPEATIPSSETGMRHRTAERVAKQTGCLIIAISERRNVITLYQENMKYILKDIGFILTKANQAIQTLEKYKLILDHAISNLNALEFEELVTFGDVISVLHRYEMVLRIKNEINMYIKELGTEGHLIRLQVSELITDMEQEAALFVKDYVKEKIKDPFVLLKQLQDMSSFELLDDAILLKLLGYSATTNMEEYVFPRGYRLLHKIPRLPMPIVENVVEAFGHLKLIIEADVKDLDEVEGIGAVRAQKIKKGLKRLQEKHYTDRQL

SEQ ID NO: 4291 - protein, 362 aa, Bacillus licheniformis
MLKRIVQAFFAILGGVIGIFLIPELFVLLNVQDIPLVTNPYASACLGAIIFFLLGIWCADHVINWVKQIEDSLIKAPVSDLLFGSLGLIFGLMLAYLIVNVIPLKDIPYQLISTVIPIVLAAFLGYLGFRVGFKKKDEMLTLFTSRKKKGSAEEERPEEDKKLKILDTSVIIDGRIADICQTGFLEGVIVIPQFVLEELQHIADSSDVLKRNRGRRGLDILNRIQKELDIKVEIYEGDFEDIQEVDSKLVKLAKLTSGVVVTNDFNLNKVCELQKVAVLNINDLANAVKPVVLPGEEMKVQVIKDGKEHNQGVAYLDDGTMIVVEEGRNYIGKHIDVLVTSVLQTAAGRMIFAKPKLLEKAL

SEQ ID NO: 4292 - protein, 231 aa, Bacillus licheniformis
MNYEVVIPAAGQGKRMNAGKNKLFIEAKGIPVIIHTLKVFENHDACKRIILVINEQEFGEFNTLLKTYHFKTPIEMVPGGRERQQSVFAGIKAAGKEETVLVHDGARPFIKREYIEQLVEKAKETGAAIVAVPVKDTIKRVQDGEIAGTIERSSLWAAQTPQAFRLSILMNAHLEAEAKGFLGTDDASLVEEAGGTVAIIQGDYQNIKLTTPDDLLVAEAILEAEKRNEHV

SEQ ID NO: 4293 - protein, 158 aa, Bacillus licheniformis
MFRIGQGFDVHQLVEGRPLIIGGITIPYEKGLLGHSDADVLLHTIADACLGAVGEGDIGKHFPDTDPEFKDADSFKLLRHVWMIVKEKGYTLGNLDCTIIAQKPKMAPYIEDMRARIAEGLEAEISQINVKATTTEKLGFTGRAEGIAAQASVLLQKV

SEQ ID NO: 4294 - protein, 485 aa, Bacillus licheniformis
MGNEVRVRYAPSPTGHLHIGNARTALFNYLFARSQGGKFIIRIEDTDRKRNIEGGEQSQLNYLKWLGIDWDESVDVGGEYGPYRQSERNDIYKTYYEELLEKGLAYKCYCTEEELEKEREEQAARGEMPRYSGKCRNLTKEEQEKLEAEGRQPSIRFKVPQGEVIRFDDIVKGEISFETDGIGDFVIVKKDGTPTYNFAVAVDDYLMKMTHVLRGEDHISNTPKQIMIYNALGWDIPAFGHMTLIVNESRKKLSKRDESIIQFIEQYEELGYLPEALFNFITLLGWSPVGEEELFTKEQFIEIFDVNRLSKSPAVFDTHKLKWVNNQYVKKLDLDQVIELTVPHLQKAGKVSEELSGSEQEWVRKLISLYQEQLSYGAEIVELTELFFKDDIQYNREARTVLEEEQVPEVLRVFAEKLEQLDSFTADEIKASIKAVQKETGHKGKKLFMPIRVATTGQTHGPELPQSIELLGKDTVLKRLHNIIQ

SEQ ID NO: 4295 - protein, 216 aa, Bacillus licheniformis
MFFKMLKEDVDVVFDQDPAARSYIEVILTYSGLHAIWAHRIAHALYKRKRFFIARAISQIARFFTGIEIHPGAKIGRRFFIDHGMGVVIGETCEIGNNVTVFQGVTLGGTGKEKGKRHPTIEDDALISTGAKVLGSITVGRGAKIGAGSVVLHDVPECSTVVGIPGRVVVQNGKKIRRDLNHQDLPDPVADRFRELENEIRQLKQELRRKEREDEL

SEQ ID NO: 4296 - protein, 467 aa, Bacillus licheniformis
MTLTLYNTLTRKKEPFVPLEEGKVKMYVCGPTVYNYIHIGNARPAIVFDTVRKYLEYKGYEVQYVSNFTDVDDKLIKAANELGEEVPVIAERFIKAYFEDVGSLGCTKADCHPRVTENMDEIIDFIQTLIDKGYAYEADGDVYYKTRSFEGYGKLSHQSVDELRSGARIQVGEKKEDALDFTLWKAAKDNEISWDSPWGKGRPGWHIECSAMARKYLGDSIDIHAGGQDLAFPHHENEIAQSEALTGKPFAKYWLHNGYINIDNEKMSKSLGNFVLVHDIIKEHDPQVLRFFMLSVHYRHPINYSVELLENTKNAFGRLKTAYSNLQHRLKSSTNLTEGDSEWLEKIEEQRKAFQTAMDDDFNTANAISVLFDLAKHANYYLQEKNTAEHVIQAFIQLFDEICSVLGFSLKEQELLDKDIEELIEKRNEARRNRDFATSDQIRDQLKSMNIILEDTPQGTRWKRGES

SEQ ID NO: 4297 - protein, 138 aa, Bacillus licheniformis
MNLETIKDAKQLNGLALAYMGDAVLEVYVRHHLLKQGMTRPNDLHRQSRRYVSAKSQASMLFALEEQEFFTEEEQAVLRRGRNAKSGTVPKNTDVQTYRYSTAFEAVIGYLFLENREDRLNELIKAALEKRDGREEVK

SEQ ID NO: 4298 - protein, 249 aa, Bacillus licheniformis
MSQQHDYVIGKNAVIETLKSGRELYKLWMAENTVKGQAQQVVDLAAKNGVTIHYVPRKKLDQMVSGQHQGVVAQVAAYEYAELDDLFQKAEDRNEQPFILVLDEIEDPHNLGSIMRTADAVGAHGIVIPKRRAVGLTTTVAKASTGAIEHIPVVKVTNLSRTLEEMKGRGIWVVGTDASGQQDYRSLDGNMPLALVIGSEGKGMGRLVKEKCDFLIRLPMAGKVTSLNASVAAGLLMYEVYRKRSPLGE

SEQ ID NO: 4299 - protein, 170 aa, Bacillus licheniformis
MDILLVDGYNMIGAWPQLKDLKENSFEEARDLLIQKMAEYQSYTGFRVIVVFDAHLVKGIEKKKVNHRVEVIFTRENETADERIEKLVSDLNSIQTQIHVATSDYTEQWAIFGQGALRKSARELLREVEAIERQIENRVKQITSERPAGKIPLSEDVLRIFEKWRRGDLD

SEQ ID NO: 4300 - protein, 223 aa, Bacillus licheniformis
MNLQNNQGKFSKEQFSKERFCQLEDEQVIEMVHVGDSDALDYLITKYRNFVRAKARSYFLIGADREDIVQEGMIGLYKSIRDFREDKLTSFKAFAELCITRQIITAIKTATRQKHIPLNSYVSLDKPIYDEESDRTLLDVISGAKVMNPEELIINQEEFDDIELKMGELLSDLERKVLALYLDGRSYQEISEELNRHVKSIDNALQRVKRKLEKYLELREISL

SEQ ID NO: 4301 - protein, 59 aa, Bacillus licheniformis
MGIIKFLKNVGKEMKKVTWPKGKELTRYTITVITTVIFFAIFFALIDSGITQLIRLIVE

SEQ ID NO: 4302 - protein, 186 aa, Bacillus licheniformis
MEKKWYVVHTYSGYENKVKANLEKRVESMGMQDKIFRVVVPEEEETDIKNGKKKVVKKKVFPGYVLVELVMTDDSWYVVRNTPGVTGFVGSAGSGSKPTALLPGEAEKILKRMGLEERKTEIDFELKETVKLSTARLLISQGRSKRSTTTKIKSKFLLICSEERPRLSSNLLKLTNCNGKALEITI

SEQ ID NO: 4303 - protein, 141 aa, Bacillus licheniformis
MAKKVVKVVKLQIPAGKANPAPPVGPALGQAGVNIMGFCKEFNARTSDQAGLIIPVEISVYEDRSFTFITKTPPAAVLLKKAAGIESGSGEPNRNKVATVKRDKVREIAETKMPDLNAADVEAAMRMVEGTARSMGIVIED

SEQ ID NO: 4304 - protein, 232 aa, Bacillus licheniformis
MAKKGKKYVEAAKLVDRTKAYDVNEAIELVKKTNTAKFDATVEAAFRLGVDPRKNDQQIRGAVVLPNGTGKTQRVLVFAKGEKAKEAEAAGADYVGDADYINKIQQGWFDFDVIVATPDMMGEVGKIGRVLGPKGLMPNPKTGTVTFEVEKAVNEIKAGKVEYRVDKAGNIHVPIGKVSFEEGKLVENFATMYDTILKAKPAAAKGVYVKNVSVTSTMGPGIKVDPSTFNVK

SEQ ID NO: 4305 - protein, 174 aa, Bacillus licheniformis
MNLTGGVTMSSAIETKKVVVEEITSKLKESKSTIIVDYRGLNVAEVTELRKQLREANVEFKVYKNTMTRRAVEQAELDGLNDFLTGPNAIAFSTEDVVAPAKVLNEFAKKHEALEIKAGVIEGKVSTVEEVKALAELPSREGLLSMLLSVLQAPVRNLALATKAVAEQKEEQGA

SEQ ID NO: 4306 - protein, 128 aa, Bacillus licheniformis
MEELQMALNIEEIIASVKEATVLELNDLVKAIEEEFGVTAAAPVAVAGGAAAGGAAEEKTEFDLVLAGAGDQKIKVIKVVREITGLGLKEAKELVDNTPKPLKEGIAKEEAEELKAKLEEVGASVEVK

SEQ ID NO: 4307 - protein, 201 aa, Bacillus licheniformis
MTDHYYSEKPSAKSSRSMWAFRLRNRTFTFISDSGVFSKREVDFGSRLLIEAFREPDAEGDFLDVGCGYGPIGLSLAADFEDRMVHMIDVNERAVELSKENALNNQIDNIKIYQSDLFANVEPAKKFASIITNPPIRAGKKTVHAIFEKSAEHLRPSGELWVVIQKKQGGPSAIEKLKELFADVEVVQKKKAYYIIKAKKV

SEQ ID NO: 4308 - protein, 1193 aa, Bacillus licheniformis
MTGQLVQYGRHRQRRSYARISEVLELPNLIEIQTSSYQWFLDEGLREMFQDISPIEDFTGNLSLEFIDYSLGEPKYPVEESKERDVTYSAPLRVKVRLINKETGEVKDQDVFMGDFPIMTDTGTFIINGAERVIVSQLVRSPSVYFSGKVDKNGKKGFTATVIPNRGAWLEYETDAKDVVYVRIDRTRKLPVTVLLRALGFGSDQEIIDLIGENEYLRNTLDKDNTENTDKALLEIYERLRPGEPPTVENAKSLLDSRFFDPKRYDLASVGRYKINKKLHIKNRLFNQRLAETLVDPETGEILAEKGAILDRRTLDKVLPYLENGIGFKKLYPNGGVVEDEVTLQSIKIYAPTDQEGEQTINVIGNAYIEEGVKNITPSDIIASISYFFNLLHGVGDTDDIDHLGNRRLRSVGELLQNQFRIGLSRMERVVRERMSIQDTNTITPQQLINIRPVIASIKEFFGSSQLSQFMDQTNPLAELTHKRRLSALGPGGLTRERAGMEVRDVHYSHYGRMCPIETPEGPNIGLINSLSSFAKVNRFGFIETPYRRVDPETGKVTPRIDYLTADEEDNYVVAQANARLNDDGSFVDDSIVARFRGENTVVPKDRVDYMDVSPKQVVSAATACIPFLENDDSNRALMGANMQRQAVPLMQPESPIVGTGMEYVSAKDSGAAVICRHPGIVERVEAKNIWVRRYEEVDGQKVKGNLDKYSLLKFVRSNQGTCYNQRPIVSVGDEVEKGEILADGPSMEKGELALGRNVMVGFMTWDGYNYEDAIIMSERLVKDDVYTSIHIEEYESEARDTKLGPEEITRDIPNVGEDALRNLDERGIIRVGAEVKDGDLLVGKVTPKGVTELTAEERLLHAIFGEKAREVRDTSLRVPHGGGGIILDVKVFNREDGDELPPGVNQLVRVYIVQKRKISEGDKMAGRHGNKGVISKILPEEDMPYLPDGTPIDIMLNPLGVPSRMNIGQVLELHLGMAARRLGLHVASPVFDGAREEDVWETLEEAGMSRDAKTVLYDGRTGEPFDNRVSVGIMYMIKLAHMVDDKLHARSTGPYSLVTQQPLGGKAQFGGQRFGEMEVWALEAYGAAYTLQEILTVKSDDVVGRVKTYEAIVKGDNVPEPGVPESFKVLIKELQSLGMDVKILSSDEEEIEMRDLEDDEDAKQNEGLSLPNDEESEELVSADAERDVVTKE

SEQ ID NO: 4309 - protein, 1199 aa, Bacillus licheniformis
MLDVNNFEYMNIGLASPDKIRSWSYGEVKKPETINYRTLKPEKDGLFCERIFGPQKDWECHCGKYKRVRYKGVVCDRCGVEVTRAKVRRERMGHIELAAPVSHIWYFKGIPSRMGLVLDMSPRALEEVIYFASYVVTDPANTPLEKKQLLSEKEYRAYLDKYGNKFQASMGAEAIHKLLQDIDLDKEVDMLKEELKTSQGQRRTRAIKRLEVLEAFRNSGNKPSWMILDVLPVIPPELRPMVQLDGGRFATSDLNDLYRRVINRNNRLKRLLDLGAPSIIVQNEKRMLQEAVDALIDNGRRGRPVTGPGNRPLKSLSHMLKGKQGRFRQNLLGKRVDYSGRSVIVVGPNLKMYQCGLPKEMALELFKPFVMKELVEKGLAHNIKSAKRKIERVQPEVWDVLESVIKEHPVLLNRAPTLHRLGIQAFEPTLVEGRAIRLHPLVCTAYNADFDGDQMAVHVPLSAEAQAEARILMLAAQNILNPKDGKPVVTPSQDMVLGNYYLTLERPGAVGEGMIFKDTDEALLAYQNGYVHLHTRVAVAVNSLKNETFTEEQRSKLLITTVGKLIFNEILPPSFPYMNEPTKSNIEEKTPDRFFLDYGADVKEAIKNQEINPPFKKGILGKIIAEIFKRFHITETSKMLDRMKNLGFKYSTKAGITVGVSDIVVLDDKQEILEEAQGKVDNVMKQFRRGLITEEERYERVISIWSAAKDTIQGKLMKSLDEINPIYMMSDSGARGNASNFTQLAGMRGLMANPAGRIIELPIKSSFREGLTVLEYFISTHGARKGLADTALKTADSGYLTRRLVDVAQDVIIRETDCGTDRGILAKAITEGTEVIERLEERLVGRFARKPVKHPETGEVLVNENELIDEDKAIEIVEAGIEEVWIRSAFTCNTSHGVCKRCYGRNLATGTDVEVGEAVGIIAAQSIGEPGTQLTMRTFHTGGVAGDDITQGLPRIQELFEARNPKGQATISEIDGVVAEINEVRDKQQEIVVQGEVESRSYTAPYNARLKVTEGEKISRGQVLTEGSVDPKELLKVTDITTVQEYLLHEVQKVYRMQGVEIGDKHVEVMVRQMLRKVRVIDAGDTEVLPGTLLDIHQFTEANKKVLLEGKRPATGRPVLLGITKASLETDSFLSAASFQETTRVLTDAAIKGKRDELLGLKENVIIGKLVPAGTGMLNYRKVKPVLQVQSSDEMVPAE

SEQ ID NO: 4310 - protein, 82 aa, Bacillus licheniformis
MSYDKVSQAQSIIIGTKQTVKALKRNSVKEVVVAKDADPCLTSGVINLANEQGVPVSMAESMKKLGKACGIEVGAAAVAIIQ

SEQ ID NO: 4311 - protein, 138 aa, Bacillus licheniformis
MPTINQLVRKGRVSKVETSKSPALNKGYNSFKKEHTNVSSPQKRGVCTRVGTMTPKKPNSALRKYARVRLTNGIEVTAYIPGIGHNLQEHSVVLIRGGRVKDLPGVRYHIVRGALDTAGVENRAQGRSKYGTKRPKKK

SEQ ID NO: 4312 - protein, 156 aa, Bacillus licheniformis
MPRKGPVAKRDVLPDPLYNSKLVTRLINKMMIDGKKGKAQTILYKSFDIIKERTGNDAMEVFEQALKNIMPVLEVKARRVGGANYQVPVEVRPERRTTLGLRWLVNYARLRGEKTMEERLANEILDAANNTGAAVKKREDTHKMAEANKAFAHYRW

SEQ ID NO: 4313 - protein, 692 aa, Bacillus licheniformis
MAREFSLEKTRNIGIMAHIDAGKTTTTERILFYTGRIHKIGETHEGASQMDWMEQEQERGITITSAATTAQWKGYRVNIIDTPGHVDFTVEVERSLRVLDGAVAVLDAQSGVEPQTETVWRQATTYGVPRIVFVNKMDKTGADFLYSVGTLRDRLEANAHAIQLPIGAEDNFEGIIDLVENVAYYYEDDLGTRSEAREIPAEYKDKAEELRASLIEAVAELDEELMMKYLEGEEITVDELKAAIRKGTCNVEFYPVLCGSAFKNKGVQLVLDAVLDYLPAPTDVPAIKGTLPDSDEEVTRESSDDAPFSALAFKVMTDPYVGKLTFFRVYSGTLDSGSYVRNSTKGKRERVGRILQMHANSREEISTVYAGDIAAAVGLKDTTTGDTLCDEKNLVILESMEFPEPVIHVAIEPKSKADQDKMSTALAKLAEEDPTFRAHTDPETGQTIIGGMGELHLDIIVDRMKREFKVEANVGAPQVAYRETFRASAQVEGKFVRQSGGRGQFGHVWIEFSPNEEGKGFEFENAIVGGVVPREYIPAVQAGLEDALQNGVVAGYPVIDIKAKLFDGSYHDVDSNEMAFKIAASMALKNAASKCNPVILEPISKVEVVIPEEYMGDIMGDITSRRGRVEGMEGRGNAQVVRAMVPLSEMFGYATALRSNTQGRGTFTMVFDHYEEVPKSIADEIIKKNQGE

SEQ ID NO: 4314 - protein, 396 aa, Bacillus licheniformis
MAKEKFDRSKSHANIGTIGHVDHGKTTLTAAITTVLHKKSGKGTAMAYDQIDGAPEERERGITISTAHVEYETDNRHYAHVDCPGHADYVKNMITGAAQMDGAILVVSAADGPMPQTREHILLSRNVGVPYIVVFLNKCDMVDDEELLELVEMEVRDLLSEYEFPGDDVPVIKGSALKALEGDAQYEEKIFELMAAVDEYIPTPERETDKPFMMPVEDVFSITGRGTVATGRVERGQVKVGDEVEIIGLQEENKKTTVTGVEMFRKLLDYAEAGDNIGALLRGVSREEIQRGQVLAQPGTITPHKKFKAEVYVLSKEEGGRHTPFFSNYRPQFYFRTTDVTGIIQLPEGVEMVMPGDNIEMTVELISTIAIEDGTRFSIREGGRTVGSGVVSSIIE

SEQ ID NO: 4315 - protein, 102 aa, Bacillus licheniformis
MAKQKIRIRLKAYDHRILDQSAEKIVETAKRSGASVSGPIPLPTEKSVYTILRAVHKYKDSREQFEMRTHKRLIDIVNPTPQTVDALMRLDLPSGVDIEIKL

SEQ ID NO: 4316 - protein, 209 aa, Bacillus licheniformis
MTKGILGRKIGMTQVFAENGDLIPVTVIEAAPNVVLQKKTSENDGYEAIQIGFDDKREKLANKPEKGHVAKAETAPKRFVKELRGVDMDAYEVGQEVKVDIFSNGEIVDVTGTSKGKGFQGAIKRHGQSRGPMSHGSRYHRRPGSMGPVDPNRVFKGKLLPGRMGGEQITVQNLEIVKVDAERNLLLVKGNVPGAKKSLVTVKSAVKSK

SEQ ID NO: 4317 - protein, 207 aa, Bacillus licheniformis
MPKVALYNQNGSTAGDIELNDSVFGIEPNESVVFDAILMQRASLRQGTHKVKNRSEVRGGGRKPWRQKGTGRARQGSIRSPQWRGGGIVFGPTPRSYAYKLPKKVRRLAIKSALSSKVNDNNLIVLEDLNLDAVKTKEMAAILKGLSIEKKALIVTADANETVELSARNLPGVTVVEANGINVLDVVGHEKLVMTKAAVEKVEEVLA

SEQ ID NO: 4318 - protein, 95 aa, Bacillus licheniformis
MKDPRDVLKRPVITERSADLMTEKKYTFEVDVKANKTEVKDAVEQIFGVKVEKVNIMNYKGKFKRVGRYSGMTNKRRKAIVKLTEDSKEIEIFEA

SEQ ID NO: 4319 - protein, 277 aa, Bacillus licheniformis
MAIKKYKPTSNGRRGMTSSDFAEITTDQPEKSLLAPLHKKGGRNNQGKLTVRHQGGGHKRQYRIIDFKRDKDGIPGRVATVEYDPNRSANIALINYVDGEKRYILAPKGLQVGTEIMSGPEADIKVGNALPLINIPVGTVVHNIELKPGKGGQLVRSAGTSAQVLGKEGKYVLVRLNSGEVRMILSACRATIGQVGNEQHELINIGKAGRSRWKGVRPTVRGSVMNPNDHPHGGGEGRAPIGRKSPMSPWGKPTLGFKTRKKKNKSDKFIVRRRKNK

SEQ ID NO: 4320 - protein, 92 aa, Bacillus licheniformis
MARSLKKGPFVDDHLMTKIEKLNEADKKQVVKTWSRRSTIFPQFIGHTIAVYDGRKHVPVYISEDMVGHKLGEFAPTRTYKGHASDDKKTRR

SEQ ID NO: 4321 - protein, 114 aa, Bacillus licheniformis
MQQAKAVARTVRIAPRKARLVMDLIRGKQVGEAVSILNHTPKAASPIIEKVLKSAIANAEHNYEMDANNLVVTQAYVNEGPTLKRFRPRAMGRASQINKRTSHITIVVSEKKEG

SEQ ID NO: 4322 - protein, 218 aa, Bacillus licheniformis
MGQKVNPVGLRIGVIRDWESKWYAGKDYADFLHEDLKIREFINQRLSDASVSKVEIERAANRVNITIHTAKPGMVIGKGGSEVEALRKALNSLTGKRVHINILEIKRADLDAQLVADNIARQLENRISFRRAQKQQIQRTMRAGAQGIKTMVSGRLGGADIARSEYYSEGTVPLHTLRADIDYATSEADTTYGKLGVKVWIYRGEVLPTKKKTEEGGK

SEQ ID NO: 4323 - protein, 144 aa, Bacillus licheniformis
MLMPKRVKYRREHRGKMRGRAKGGTEVHFGEYGIQAQESSWITNRQIEAARIAMTRYMKRGGKVWIKIFPSKPYTAKPLEVRMGSGKGAPEGWVAVVKPGKVLFEISGVSEEVAREALRLASHKLPIKTKFVKREEIGGESNES

SEQ ID NO: 4324 - protein, 74 aa, Bacillus licheniformis
MKKLVVNQMKANEIRDLTTAEIEQKVKSLKEELFNLRFQLATGQLENTARIREVRKSIARMKTVIREREIAANK

SEQ ID NO: 4325 - protein, 87 aa, Bacillus licheniformis
MSERNQRKVYQGRVVSDKMDKTITVVVETYKKHSLYGKRVKYSKKFKAHDENNQAKIGDIVKIMETRPLSATKRFRLVEVVEEAVII

SEQ ID NO: 4326 - protein, 43 aa, Bacillus licheniformis
MIQQETRLKVADNSGAREVLTIKVLGGSGRKTANIGDVIVCTG

SEQ ID NO: 4327 - protein, 103 aa, Bacillus licheniformis
MHVKKGDKVMVISGKDKGKQGVILAAFPKKDRVIVEGVNMVKKHSKPTQANPQGGILNQEAPIHVSNVMPLDPKTGEVTRVGYKVENGKKVRIAKKSGQVLDN

SEQ ID NO: 4328 - protein, 179 aa, Bacillus licheniformis
MNRLKEKYNKEITPALMKKFEYKSVMQVPKIEKIVINMGVGDAVQNAKAIDSAVEELTFIAGQKPVVTRAKKSIAGFRLREGMPIGAKVTLRGERMYDFLDKLISVSLPRVRDFRGISKKSFDGRGNYTLGIKEQLIFPEIDYDKVTKVRGMDIVIVTTANTDEEARELLTQLGMPFQK

SEQ ID NO: 4329 - protein, 61 aa, Bacillus licheniformis
MAKKSMIAKQKRTPKFKVQEYTRCERCGRPHSVIRKFKLCRICFRELAYKGQIPGVKKASW

SEQ ID NO: 4330 - protein, 132 aa, Bacillus licheniformis
MVMTDPIADMLTRIRNANMVRHEKLEIPASKLKREIAEILKREGFIRDVEFIEDNKQGIIRVFLKYGQNNERVITGLKRISKPGLRVYAKSNEVPRVLNGLGIAILSTSQGVLTDKEARAKQAGGEVLAYVW

SEQ ID NO: 4331 - protein, 183 aa, Bacillus licheniformis
MEVFGMSRVGKKLLEIPSGVTVTLNDNTVTVKGPKGELTRTFHPDMKIKIEDNVLTVERPSDNKEHRALHGTTRSIIGNMVEGVSKGFERGLELVGVGYRASKSGNKLVLNVGYSHPVEIVPENGIEIEVPSQTKVVVKGTDKERVGATAANIRAVRSPEPYKGKGIRYEGEMVRRKEGKSAK

SEQ ID NO: 4332 - protein, 123 aa, Bacillus licheniformis
MTQMITKTSKNAARLKRHARVRAKLSGTPERPRLNVFRSNKHIYAQVIDDVNGVTLVSASTLDKDFNAENGSDTAAAAKVGELVAKRASEKGITNVVFDRGGYLYHGRVKALADAAREAGLEF

SEQ ID NO: 4333 - protein, 168 aa, Bacillus licheniformis
MNMRRIDPSKLELEERLVTVNRVAKVVKGGRRFRFAALVVVGDKNGHVGFGTGKAQEVPEAIRKAVEDAKKNLIEVPMVGTTIPHEIIGRFGAGNILLKPASEGTGVIAGGPVRAVLELAGVSDILSKSLGSNTPINMIRATVQGLSELKRAEDVAKLRGKSVEELLG

SEQ ID NO: 4334 - protein, 59 aa, Bacillus licheniformis
MAKLEITLKRSVIGRPEDQRITVRTLGLKKTNQTVVHEDNAAIRGMINKVSHLVSVKEL

SEQ ID NO: 4335 - protein, 146 aa, Bacillus licheniformis
MKLHELKPAEGSRKTRNRVGRGIGSGNGKTAGKGHKGQNARSGGGVRPGFEGGQMPLFQRLPKRGFTNINRKEFAVVNLDKLNSFAEGTEVTPELLLETGVISKLKSGVKILGDGKLEKKLTVKANKFSASAKQAIEAAGGTAEVI

SEQ ID NO: 4336 - protein, 431 aa, Bacillus licheniformis
MFKTISNFMRVKDIRNKIIFTLLMLIVFRLGSFIPVPHVNTEVLKAQDQMSVFGILNTFGGGALFNFSILAMGIMPYITASIIIQLLQMDVVPKFTEWSKQGEVGRRKLAQFTRYFTIVLGFIQALGMSYGFNNMAGGALITDPGVGTYLLIAIVLTAGTAFLMWLGEQITSHGVGNGISIIIFAGIVAGIPQTINQIYAQQFVDAGDQLFLQIIKVVVILVAILAIVVGVIFIQQAVRKISIQYAKGSGRSPVPGGQSTHLPLKVNPAGVIPVIFAVAFITTPRTVATFFGSNDVTNWIQKTFDYTHPVGMGVYAALIIAFTYFYAFVQVNPEQMADNLKKQGGYIPGVRPGKMTQDRITSILYRLTFVGSIFLAVIAILPVLFVNIAGLPSSAQIGGTSLLIVIGVALETMKQLESQLVKRNYRGFMKH

SEQ ID NO: 4337 - protein, 217 aa, Bacillus licheniformis
MNLVLMGLPGAGKGTQAERIVEDFGIPHISTGDMFRAAMKEETDLGLEAKSYIDKGELVPDEVTIGIVRERLGKNDCDGGFLLDGFPRTVAQAEALEEILKGLGKSIDHVINIQVDKDALMERLTGRRICKNCGATYHLVFNPPAKENVCDKCGGELYQREDDNEATVSTRLEVNMKQTQPLLDFYEDKGYLVNIDGQKHINEVYADIKELLGGRDK

SEQ ID NO: 4338 - protein, 248 aa, Bacillus licheniformis
MIICKTPREIEIMREAGRIVALTHQELKKHIKPGISTKELDQIAERFITKQGAIPSFKGYNGFRGSICVSVNEELVHGIPGKRVLRDGDIISIDIGAKLNGYHGDSAWTYPVGTISDDDQKLLDVTEESLYRGLKEAKPGERLSNISHAIQTYVESEQFSVVREYVGHGVGQDLHEDPQIPHYGPPNKGPRLKPGMVLAIEPMVNAGTRYVKTLADNWTVVTVDGKKCAHFEHTIAITDAGFEILTKA

SEQ ID NO: 4339 - protein, 109 aa, Bacillus licheniformis
MYRKTPEIGQFVRMTRGREMNQYAVVIDIVDHHHVLVADGEKRKFHSPKKKNINHLTFYDCVSPEVQNSINETGRVTNGKLRFSLLKFVREQVTDLKKGEHLNGERRCN

SEQ ID NO: 4340 - protein, 72 aa, Bacillus licheniformis
MAKDDVIEVEGTVVETLPNAMFKVELENGHTVLAHVSGKIRMHFIRILPGDKVTVELSPYDLTRGRITYRYK

SEQ ID NO: 4341 - protein, 37 aa, Bacillus licheniformis
MKVRPSVKPICEKCKVIRRKGKVMVICENPKHKQKQG

SEQ ID NO: 4342 - protein, 121 aa, Bacillus licheniformis
MARIAGVDIPRDKRVVISLTYIFGIGRTTAQQILKEAGVSEDTRVRDLTEEELGKIRDVIDKLKVEGDLRREVSLNIKRLIEIGSYRGIRHRRGLPVRGQNTKNNARTRKGPRRTVPNKKK

SEQ ID NO: 4343 - protein, 131 aa, Bacillus licheniformis
MAAARKTNTRKRRVKKNIESGIAHIRSTFNNTIVTITDVHGNALSWSSAGALGFKGSKKSTPFAAQMAAETAAKGSIEHGLKTLEVTVKGPGSGREAAIRALQAAGLEVTAIRDVTPVPHNGCRPPKRRRV

SEQ ID NO: 4344 - protein, 314 aa, Bacillus licheniformis
MIEIEKPKIETVEISDDAKYGKFVVEPLERGYGTTLGNSLRRILLSSLPGAAVTSIQIDGVLHEFSTIEGVVEDVTTIILNIKKLALKIYSEEEKTLEIDVQGEGVVTAADITHDSDVEILNPDLHIATLGQNASFRVRLTAQRGRGYTPADANKRDDQPIGVIPIDSIFTPVSRVSYQVENTRVGQITNYDKLTLDVWTDGSTGPKEAIALGSKILTEHLNIFVGLTDEAQHAEIMVEKEEDQKEKVLEMTIEELDLSVRSYNCLKRAGINTVQELANKTEEDMMKVRNLGRKSLEEVKAKLEELGLGLRKDD

SEQ ID NO: 4345 - protein, 120 aa, Bacillus licheniformis
MSYRKLGRTSAQRKAMLRDLTTDLIINERIETTEARAKELRSVVEKMITLGKRGDLHARRQAAAYIRNEVADAEKNQDALQKLFSDVAPRYEERQGGYTRIMKLGPRRGDGAPMAIIELV

SEQ ID NO: 4346 - protein, 281 aa, Bacillus licheniformis
MNQERLIAAEDITFRYQKDADRPALDHVSFHVSKGEWLAIVGHNGSGKSTLARALNGLILPDEGSIKVGGIKLTEETVWDVRKKVGMVFQNPDNQFVGTTVRDDVAFGLENSGVPREDMVERVDWAVQQVNMQEFLDQEPHHLSGGQKQRVAIAGVLAARPDIMILDEATSMLDPMGREEVLDTVRRLKDQGMVTVISITHDLNEAAKADRIIVMNSGRKFAEGTPQEVFRLNQDLIKIGLDLPFSFQLTQMLKESGLALKGDHLTQEGLVNELWTLKSKM

SEQ ID NO: 4347 - protein, 289 aa, Bacillus licheniformis
MDIEIKDVEHRYQMKTPFERLAIYDVNAVIKEGSYVAVIGHTGSGKSTLLQHLNGLLKPTKGQIRLGEDVLEAGKKNKHLKALRKKVGIVFQFPEHQLFEETILKDIAFGPINFGMSREKAEEKAREMLKLVGLGAELSDRSPFELSGGQMRRVAIAGVLAMEPEVLVLDEPTAGLDPRGRKEIMDMFYSLHKQRNLTTILVTHSMEDAAAYADELIVMHKGTVKAKGTPRELFSRKDDIAALGLDLPETIKFQKRLEETLGITFKAPILTIEEAASEVKALFQEENAL

SEQ ID NO: 4348 - protein, 265 aa, Bacillus licheniformis
MMDNIIIGKYVPGKSVIHRLDPRTKLLTIFLFVFIVFFANNTETYALLGLFTVAAAALSGVPVRFLIKGMKPVFWIVLFTFLLHIFMTREGPVLADLGLFKIYEQGLVQGIFISLRFVYLIMITTILTLTTTPIEVTDGLEHLLGPFKKLKLPVHELALMMSISLRFIPTLIEETDKIMKAQMARGVDFANGPVKERVKAIVPLLVPLFVSAFKRAEELATAMEARGYRGGEGRTKYRQLTWKWKDTSVLLILAVLGVLLILLRT

SEQ ID NO: 4349 - protein, 247 aa, Bacillus licheniformis
MRMKCTISYDGHLFYGYQVQPGQRTIQDELEKALQTLHKAKERIPVVSSGRTDSGVHAVGQTIHFDSPLSIPEAKWPYALNALLPDDISVRKAEAVNDQFHARFSAKRKEYRYMIYRGRHPDVFKRYYAYHVPYDLDMEKVKEASRYLVGTHDFTSFCATKTEVKDKVRTVHELEWSDTGDGLQMRIVGSGFLYNMVRIIAGTLLDVGTGKFSPGDIEKMILAKNRDAAGRTAPAHGLYLWRVIYDN

SEQ ID NO: 4350 - protein, 145 aa, Bacillus licheniformis
MRTTPMANASNIERKWLVVDAAGKTLGRLSTEVASILRGKHKPTYTPHVDTGDHVIIINAEKIELTGKKLTDKIYYRHTQHPGGLKSRTALEMRTNYPEKMLELAIKGMLPKGSLGRQMFKKLNVYRGSEHPHQAQKPEVYELRG

SEQ ID NO: 4351 - protein, 130 aa, Bacillus licheniformis
MAQVQYYGTGRRKSSVARVRLVPGEGRIIVNNREISEHIPSAALIEDIKQPLTLTETAGTYDVLVNVHGGGFSGQAGAIRHGIARALLEADPEYRSTLKRAGLLTRDARMKERKKYGLKGARRAPQFSKR

SEQ ID NO: 4352 - protein, 152 aa, Bacillus licheniformis
MKGLFQYNWEVRHAWFKWCLSQPQEELVKKRSGGMGSIKKNLFHIVDVEVSWIYAILEKPDIQPDYSHYQTIQQIARFSDLHRSEIESVIFNYSSAFEHLPVKAAWSDEVCTQGDILRHLIAHEIHHIGQISVWTRESGSAPVSASYIGRKI

SEQ ID NO: 4353 - protein, 147 aa, Bacillus licheniformis
MGTVVSFNNEKQKKQINLEKQLLRELSLEKMLNSAEECFAPLFHFFSKHTDILYDGCIDFAIEAYLLGAEYGKFGYHGEPVHRAMIRSEKEEKQLLHELYEYAVSWSEAFNVQAAYEPLYYACEYFIQSWWKEGFSQRERRFKLRLR

SEQ ID NO: 4354 - protein, 237 aa, Bacillus licheniformis
MKKKIKWLGFLLGFVVLLCLFQYQFNNDDSWRSWNLPLSGKIIYIDPGHGGADGGASSGELLEKDVALEVSLRIRDYLQEQGALVMLTREDDHDLAPEETRGLSRRKAEDLRKRVDMINNSEADLYLSIHLNAIPSARWSGAQSFYYGQYEENERAAKFIQDELRHNLENTTRKAKRIHGIYLMQNVKKPGALVEIGFLSNPEEAKQLAKPKYQDKIAASVYKGVLRYFTEDRDPPE

SEQ ID NO: 4355 - protein, 352 aa, Bacillus licheniformis
MREDDVKKIVGDLDEPFLHKPLRELDAVKEIKIKPEKRHVSVKVALAKTGSAEQMQLQQEIVIRLKEAGAETVGLRFEELPEEVVMSYQESAKGQDQSLLNSEKQPVFLAVASGKGGVGKSTVSVNLAVSLARIGKKVGLIDADIYGFSVPDMMGITVRPTIEGEKVVPVERFGVKVISMGFFVEDNAPVIWRGPMLGKMLNNFFHEVEWGDVDYIILDLPPGTGDVALDVHSMLPSCKEVIVSTPHPTAAFVAARAGAMALKTDHEIVGIVENMAYYESVKTGEKEYVFGKGGGEKLAEELGVPILGKIPLKQPDWDDSEFAPSVYDESHPTGAIYLDIAKKIDESIGAKA

SEQ ID NO: 4356 - protein, 193 aa, Bacillus licheniformis
MFKTAMLSISCFLFLSVTACAPTDQAAEMDYDQTKKMVVDILKTDDGKKAIQEILNDDKLNETLVMDEKTVKETVEKTMTSKKGAEFWKKVFEDPKFAEGFAKTLQNEHEKVLKKLMKDPEYQKMLMQVMQDPEMAKKYGELVRSQEFRSHLQEVISDTLTSPLYRKQFEEELKKAAAESMKEEMKGGEEKQS

SEQ ID NO: 4357 - protein, 199 aa, Bacillus licheniformis
MKSRNLVRFFFSVLGVGALTTSIVGFAIEWGRYKELFLSFEVLEILSVLFWFIGVGMIFSVIAQMGFVIFLTIHRFALEIFRSHSLWNSIQLFLIIFVAFDLVYLRFLFFEKDGGSIIPYIWLPLFILAVGIAAAYAKQKQSSKKTFVSALFLMFVFTVMEWFPALRVNEEDWLYLMLLPLLACNAFQLLMLPKFQARA

SEQ ID NO: 4358 - protein, 254 aa, Bacillus licheniformis
MNHFYVWHIKRIKQLIIIMIAAFATASFFYVQNLLPLPVFSTEGGAKAVYRGDSDTNEVALTFNISWGDQKAMPILDTLKANGIKDATFFLSASWAERHPDVVERIRKDGHQIGSMGYAYKNYSQMKKSEIKKDLAKARHSFQKLGLDDLTLLRPPTGQFNKDVLDVAKQYGYTVVHYSINSDDWTNPGVQKIVQNVNGTVNAGDIVLFHASDSAKQTKEALPEIVHHLRSKGLKNVTVSELIANTDAKSSEVK

SEQ ID NO: 4359 - protein, 389 aa, Bacillus licheniformis
MARTYRTRIKKRKKQKTKRRLIIFSFLVVCGLIYLALPSGMRDHQENQLQATEKKAQPEAKKKPTQNETKKSKIVTKNDNAQLDQYLKSIGFSGTALIVEDGKVVTSKGYLYANREEMVPNTPDTVFYVGSSQKAIIATAILQLEEKGLLSVNDPVSKYLPNFPNGSKITLYHFLTHTSGIRGHKEGRGYISPEDLIKDIEKRGVKYPTGKWDYRDSNYSVLAYIVSMVSGEPVDQYIKKHIFKPAGMKHAGFYKTFAKESNPSTGYKLNLQKKLYTPDMPDLSQLYGAGDIYMTAYDMYLFDKALYERKIISNESFMKMFTPNKATYGMGFYVSPGSYSSHGVMPGYNILNSFSLTGSRYVILFSNIQNNIKSFGSVNNRIFSILNGF

SEQ ID NO: 4360 - protein, 54 aa, Bacillus licheniformis
MKKSGFSKRAILVKEIKNGYVKAFCFQKQQIRMFKIESILSVFPYKKRNSAHYA

SEQ ID NO: 4361 - protein, 325 aa, Bacillus licheniformis
MLQTINKTLGKIMPLLTPLSVVSGVLLADYLNGLASLVPWIFAFMTFAGSLGANFQSLKTAVAHPLPMFLALFVLHIFMPVLAWSTGHLVFSGDSLTITGLTLGVVIPTGITSMIWAAMYKGNIGLTLSIILVDTILSPFIVPFSLSILAGAHVEMDVIGMMKGLVGMIVIPSLLGMLVNQFSTPERTVRLSANCAPFSKVGLAAVVAINSSVVAPYLKNVDLKFLTIAVTVFLVAFTGYLTAWLIGRLMKRPQEEIVALIFTGGMRNISAGAVLATSFFPPQVAVPVVIGMLFQQILAALFGHLLARSELKKAHHLDKKTSLPS

SEQ ID NO: 4362 - protein, 137 aa, Bacillus licheniformis
MKTNRVSVMIWTLISAFLFCSMIVAASLSPLAHSGPHANEFGTLGMWAAIGTVLLFYMLPLAVYMAGFDAMKFVMAVLCGIGLIITLTMSPVFVLIGAIGGNASALLGVAGLCVLLAIVNVIWLVVAFRRTSASASF

SEQ ID NO: 4363 - protein, 289 aa, Bacillus licheniformis
MDFYLVDVFAETKYTGNQLAVFKAEKNLSSDEMQKIAREINFSETTFILGKQGNGGYDVRIFTPEKEIPFAGHPTLGTAFIIKNEIETEPSSNVILNVTAGAIPVTFEKGADQIIWMKQNPPVFNRTFDKEMMAGVIGIDTSDMDSNFPIQEVSTGLPAVIVPLNSLNAVKKCKINKDRFEAFMKETEASLLVFTTETYHEQNHINARVFCDCFSVPEDPATGSAIGGLAGYLLHHGYFNQHYLSIRAEQGFEINRPSLLHLEAQITENSTEIHVGGNVHLIAKGSWQI

SEQ ID NO: 4364 - protein, 409 aa, Bacillus licheniformis
MGKKAIWLLAGMFVFSTLTAAAAFPDKEKKAKVSPGIEVLMNKKSILKGKRVGLITNPTGVNSTLTSSIDLLHQAPGIELTALYGPEHGVRGDAQAGDKVDSYIDEKTGLPVYSLYGDTRKPTPEMLKNVDVLLFDIQDVGTRFYTYIYTMAYAMEAAKENDIPFIVLDRPNPQNGLKVEGPVLDPDYSSFVGMYPVPLSHGMTAGELAKLFNDEFNIGADLTVIKMKGWKRQMFFEDTGLPFVLPSPNMPTPDTSIVYPGTGLIEGTNMSEGRGTTKPFELIGAPYMKSTELAEKLNGLKLPGVRFRAASFNPTFSKHQNKLCHGVELYVTNRSAFKPVNTGIAIIKTVHDLYPDDFEFLPSGNFNRLIGNGWVKTMIEQGASIDEIAKKYEAEQKRFMNIRKKYLLY

SEQ ID NO: 4365 - protein, 643 aa, Bacillus licheniformis
MKRFLQCALIALLLSSLALQPAAREAEAKQRPEQNIKQMVSSMSLEEKIGQMLMPDFRNWKKKGESSAKGLTEMNDEVAGIIEKYRLGGVILFAENVTGTEQTVRLTDGLQQASPDIPLFITIDQEGGIVTRLESGTNLAGNMAVGASRSSKNAFRSGKIIGKELSSLGINVNFSPVLDVNNNPDNPVIGVRSFSSKPELTSKLGIQMMKGLQDEQMIATAKHFPGHGDTAVDSHYGLPLVPHNEKRLRSVELAPFQKAIDAGIDMIMTAHVQFPAFDDTTYKSKKDGEDIMVPATLSKKVMTDLLRKDLSFKGVVVTDALNMKAISDNFGQEEAVVMAVKAGVDIALMPAQVTSLETEKNLARVFEALLTAVKNGDIPMEQIDQSVERILQLKIDRGIIDHTGSEPLQKKIKYALKTVGSSKHMKYEKKMARDSATILKNDKSTLPFKPKKGDTVLILAPYEEQTAAIAKTISKIRKNIKVVEYRFAEKTFEEEIQKKIDEADYVITGSYVIKNDPVVNDGVIDDSIQDSSKWATAFPRAAMKYAQANGKKFVLMSLRNPYDTANFEEAEAVIAVYGFKGYANGRFRQPNIPAGVEAIFGKAKPKGTLPVDIPSVTRPGETLYPYGYGLNIKNGKPLHKGGS

SEQ ID NO: 4366 - protein, 448 aa, Bacillus licheniformis
MISAAASLLLLTCFFPLPSTAQTAIGNETKQRLTYPVLTKAKTPEEAGFSSKKLKAVDRLIEQDVKAGFPGAALILIKDGKIIKKEVYGYKQKYNGLIALKHPKKMKANTMFDLASNTKMYAVNFALQHLVSTGKLDLNKNISQYLPDFKDHPEDDVKGKNRLRVIDLLHHNAGFPASWNYYDPKSAGHLYSQSRSKTLEYLVKTPLAYEPGTKQIYSDIDYMLLGLIIEKITNERLDTFVENRFYRPLGLRHTLFNPLQKGFKRSHFAATERLGNTRDGTISFPNIRTYTLQGEVHDEKAFYSMEGVSGHAGLFSTVDDAAVLLQVMLNGGGYGRQHLFSSSVISQFTEPSKTNPTYGLGWRLNGNTDMEWMFGKHASSKAYGHTGWTGTVTIIDPVYQIGIVLLTNKKHSPVINPKENPNQFEGDEFATGKYGSVITAVYEALHHQ

SEQ ID NO: 4367 - protein, 455 aa, Bacillus licheniformis
MSDEKKYAGLARLILQHIGGPSNVADHTHCMTRLRITPVNSQKTDIDSIKALEGVIGVVEEETLQIILGTGVVQHVSDEFGKLLKSAEHVDLKESAAKHKAEISKKNATPFKLFLRRIASIFIPLIPALVASGLITGITKAVIQAGWLAETSQTAIILTVIGSGLFTYLGILVGINTAKEFGGSPALGGLAGILIINPAVGEISLFGEALLPGRGGLIGILFAAAFIAFLEKRVRRLVPHSLDIIITPTVSLLITGIVTYVVFMPVGGLISDAITSGLLAILDLGGIIAGFVLGATFLPLVVTGLHQGLTPVHMELINSIGDDPLLPILAMGGAGQVGAAFAIYFKTKKAKLKRAIAGGLPSGLLGIGEPLIFGVTLPLGRPFLTACLGAGVGGAFQAYFKIATVSIGVSGLPLSFLVHTHQVLLYILGLFISYAAGFVLTYSFGFKDDMAVEFD

SEQ ID NO: 4368 - protein, 282 aa, Bacillus licheniformis
MAAGGLEIIQNMLHKLPQSERKLAEYILKNPHEIVNGTIQEVSSSAKTSGAAAIRLCKSLGLKGFQDLKMRVAGDLMKPSDQGYRDIEPQEPLHSIVQKTTSNSIQAIRDTFENIDHEELQKAIQILINAETVHFCGIGASGIVAQDAQQKFLRINKKATAFSDMHLVATLIANAGENDVLFAISHSGETQEIANAVRLAKKHGIKTIGLTRLGQSAVASLSDIALYTSCSNEAPFRSAATSSRLTQLYMIDLLFLGMAAERYEDIIQYIDQTKAAIRMMGI

SEQ ID NO: 4369 - protein, 304 aa, Bacillus licheniformis
MENSHLGSLTTERRNERSKRIHQAETIDMLKIMNDEDKTVAEAVQEVLPDVKTAVDYAVGSLKKGGRIIYIGAGTSGRLGVLDAAECPPTFSISPESVIGIIAGGEKALYNAVEGAEDHEAFGRRDLEAVNLSNNDTVIGIAASGRTPYVLGALKYAKKTGAKAISLTCNENSAISQAADHSIEVVVGPEVIAGSTRMKAATAHKMILNMISTAAMIKMGKVYENLMVDVKVSNDKLKERAIRIIQTVTGMPNETAAQALEMSNNQVKTAIIMLKTNEDAAAAEKLLEKSEGDIEKALSIYEKS

SEQ ID NO: 4370 - protein, 150 aa, Bacillus licheniformis
MILVSSCLAGVECRYNGSHSYVEKINKLVEEKKAVMACPELLGGFQTPREPAEIIGGTGEDVLDGKAVIKTQSGNDVTDLYVKGAYQTLEMARQIKADTIVLKENSPSCGSSHIYDGSFSSKKIAGNGLTAALLKKEGFRVISEHQIDEL

SEQ ID NO: 4371 - protein, 304 aa, Bacillus licheniformis
MLKQQISMIGVPMDLGQLRRGVDMGPSAIRCAGVNERLECLCQDIEDLGDMTIGQREDEKEGGEPASEELRNLKAITKASVKLAETVDNIVASGAFPLVLGGDHSIAIGTLAGLAKHYQNLGVIWYDAHADLNTKETSPSGNIHGMPLAISLGIGHEGLTAIYGKEAKIKAENIVIIGARSLDDGEKELIRDKGIKVYTMHEIDRLGMTRVMEETIDYLRGRTDGVHLSLDLDALDPNDAPGVGTPVAGGISYRESHLAMEMLEESKLITSAEFVEVNPILDEKNRTAEAAVALMGSLFGEKLL

SEQ ID NO: 4372 - protein, 187 aa, Bacillus licheniformis
METMIKKRIKQVKKGDRNAFADIVDIYKDKIYQLCYRMLGNAHEAEDIAQEAFIRAYVNIDSFDINRKFSTWLYRIATNLTIDRIRKKKPDYYLDAEVAGTEGLTMYSQVAADVALPEDEVVSLELHSTIQEKILRLPDKYRTVIVLKYIDELSLIEISEILNIPVGTVKTRIHRGREALRKQLRDL

SEQ ID NO: 4373 - protein, 206 aa, Bacillus licheniformis
MSCPEHIVQLMHKYLDGDILPEDETRLKEHLQSCEGCKKHLHEMEKSIALVQSTSHLTAPANFTANVLANLPKEKRTASINRWLKAHPFLVAAALFAILMGGSFFSSWKNDHDFSVSSQPNLVVKNNTVIVPEGEVVKGDVTVKNGKLIIEGKVDGDVTIVNGEKYTASAGQVTGQIHEINEVFDWIWYKIKSTGKSVFGVKESKE

SEQ ID NO: 4374 - protein, 282 aa, Bacillus licheniformis
MTEFLEDEEMAFEDIPFLQYLGDAVDILLVWYVIYKLMMVIRGTKAVQLLKGIVVIVLVRLASQYLGLSTLQWLVDQAITWGFLAIIIIFQPELRRALEQLGRGRFFSRSGTPEEEQQQKTIDAITKAIKYMAKRRIGALLTIERETGMGDYIETGIPLNAKVSSELLINIFIPNTPLHDGAVIMKNDEVAAAACYLPLSESPFISKELGTRHRAAVGISEVTDSLTVVVSEETGGISVAKNGDLHRDLSEEALKNMLEAEFKKNSRETSSNRWYWRAKKNG

SEQ ID NO: 4375 - protein, 438 aa, Bacillus licheniformis
MDKFLNNPWAVKVVALLFAFLLYFAVHSAQAPTPKKPGESFFPTSTTDEATLTDIPVKSFYDDENYVVTGVPQTVNVTIKGPTGTVKKVRQVKDFEIYADMQNLKTGRHKVELKARNVADGLTLTINPSVTTVTIEEKTTKEFPVEVDFYNKNKMKDGYTPELPIINPKNVSVTGSKAVIDRIQNIKATINLEGVDQTVEKEAKLTVYDKDGNVLPVEVSPSVVKITVPVTSPSKKIPVKVDRKGSLPDGISISSLDISPGEVTVYGPQNVLDSLEFVEADEIDLSKIKDDTELEAGIKVPDGAKKVSPEKVKIKVKVDKEEEKKLKNVSIKTAGLNDSRDLEFLDPKSGKLDITAKGSTAAIEKLQPSDVELYVNVADLDDGEHNVKLEVNGPQNMTWSLPRQSIRVKISSQTTQNEKNNGQDEEEENHSEKDSQPS

SEQ ID NO: 4376 - protein, 448 aa, Bacillus licheniformis
MGKYFGTDGVRGVANSELTPELAFKVGRFGGYVLTKDKERPKVLIGRDTRISGHMLEGALVAGLLSIGAEVMRLGVISTPGVAYLTKAMDAEAGVMISASHNPVQDNGIKFFGGDGFKLSDEQELEIERLMDQPEDHLPRPVGADLGMVNDYFEGGQKYLQFLKQSADEDFTGIHVALDCAHGATSSLATHLFADLDADVSTMGTSPNGLNINDGVGSTHPEALAEFVKEKGADVGMAFDGDGDRLIAVDEKGNIVDGDQIMYICAKYLKSEGRLTDNTVVSTVMSNLGFYKALEAEGIKSVQTAVGDRYVVEAMKKGGFTLGGEQSGHLIFLDYNTTGDGLLSAIMLMNTIKMTGKPLSELAAEMQKFPQLLLNVKVTDKHKVTENEKVKAVIEEVEKEMNGDGRILVRPSGTEPLVRVMAEAKTKELCEKYVGRIADVVKAEMGAE

SEQ ID NO: 4377 - protein, 600 aa, Bacillus licheniformis
MCGIVGYIGQLDAKEILLKGLEKLEYRGYDSAGIAVANEDGVHVFKEKGRIADLRAAVDANVKSQAGIGHTRWATHGEPSRLNAHPHQSASGRFTLVHNGVIENYVQLTREYLHDVTLKSDTDTEVVVQVIEQFVNNGLDTEEAFRQTLMLLKGSYAIALFDHENKETIYVAKNKSPLLVGLGDNFNVVASDAMAMLQVTNEYVELMDKEMVIVTDKKVVIKNLDGELMSRASYIAELDASDIEKGTYPHYMLKEIDEQPLVMRKIIQTYQDENGKLSIPGDISNAVAEADRVYIIACGTSYHAGLVGKQFIETWAKVPAEVHVASEFSYNMPLLSEKPLFIFISQSGETADSRAVLVQVKKLGHKALTLTNVPGSTLSREADYTLLLNAGPEIAVASTKAYTAQIAVLAILAAVTAESRGKELGFDLVKELGIIGNAMEALCDQKDEMEMIAREYLTVTRNAFFIGRGLDYFVCLEGSLKLKEISYIQAEGFAGGELKHGTIALIEDGTPVIALATQEHVNLSIRGNVKEVTARGANPCVISLKGLEEADDRFVLPEVHPELAPLVSVIPLQLIAYYAALHRGCDVDKPRNLAKSVTVE

SEQ ID NO: 4378 - protein, 107 aa, Bacillus licheniformis
MNNETYIEVNRTSQLMNKMRKFTVLIDGVEAGKIKDGGRLRIDLEPGEHEIQVKIDWCVSQALRFTLDEGEVLKFRCGSPVRGWKMFFGLFYVLADPEKYSFIELEE

SEQ ID NO: 4379 - protein, 202 aa, Bacillus licheniformis
MFNLILKDIILQKKTLAASFLVLCVYLMLDISPIWVGVVFSIVISMYAFSIDEKSSIHMLLNSLPYTRKEIVSSKYIVVVLFTSMVAAAIFIVHFIIHREFTIWKDILLMVAIVMTAASFMLPFCYKFKSNYLVIASIAAFGLYMLTINFLVQNLNDQIREFIHMLLTLQNTFLYLIVAISIITLYGCSWLLSIRIYRNKVF

SEQ ID NO: 4380 - protein, 293 aa, Bacillus licheniformis
MDNVIELRHVHKSFDGFQLKDFSMSVKKGFITGFIGGNGVGKSTTIKLIMNLLQPDSGTITVFGMNYKEHEKEIKQRIGFVFDSNIFYEHLTLAKMKDIVKRSYVNWDEQVFNDYVNTFNLPLTKKIKTFSKGMIMKASLTVALSHHAELIIMDEPTSGLDPIFRRELLEILHQLMQDGDKTIFFSTHITTDLDKIADYITFIDKGEHIFTKDFYEIEEQYAIVKGGMELLDRETEQEFIAVRKSTHGFEALTANKSRTEKIFGDMALIEKPTLEDIMFYTKKGAKEHVQLNS

SEQ ID NO: 4381 - protein, 125 aa, Bacillus licheniformis
MKIIISNSSKQPIYEQIYTQIKDQILANELKPGQPLPSMRQLAKDMNVSLITSKRAYEELEKNGFIYSVVGKGSFVSDQNDEIMKEGKMKAIEEQLSAVIKNSKDIGVTLTELKDLLTILYQEEE

SEQ ID NO: 4382 - protein, 82 aa, Bacillus licheniformis
MQWLKEPDRHFKPHEGIDMNTIGVCVSPISDKLKMTQSPASQYLAILLRAGLIKAERIGKYTYCKRDEEAIGKLADFLKTEI

SEQ ID NO: 4383 - protein, 390 aa, Bacillus licheniformis
MFSTWKIYLLAIISFLVGTSEYIISGILDQIAHTLGITLAAAGQLITIFSLVYAVFTPVLMALTASMDRRKLMMYALGLFVIGNILAFTLPGYGWFVAARVVMALGAGMVVVTALTIAAKIAPAGKQGSAIATVVMGFTASLIIGVPLGRMTAEALGWKSVFGGIALLGFIAMIVLFLTLPHTEGDKPVPLLQQLSLLKKRKVAMGLSVTFFWLGGYSVAYTYLSPYLLTVSGISGNLLSGVLLIFGIASLVGSKFGGYSTDKWGVPFTLVGGMALHIIALILLSLVTHSYVGVLLILILWSFAAWSTGPTQQYHLATLEPELSGVLLGINQSMMQFAMAAGAGIGGIFVEKVSLASITWFGALGVMIAIVVVLTTFSSRKAAHVREISS

SEQ ID NO: 4384 - protein, 134 aa, Bacillus licheniformis
MNFQLEEAIEILERTPQTLSQLLTGLSNPWISCDEGEDTWNAFDVVGHLIEGEKNNWLPRIKMIVTKGATETFPPFDRFSQLNQNDGKTIEQLLNEFAEIRRANLKTLRQILDPETDFEQTGMHPEFGIVKLRE

SEQ ID NO: 4385 - protein, 578 aa, Bacillus licheniformis
MKTENNNSMKPFFSMILTSGVPRLALSAGLTASLVTTLVGLSIPLLTREMVDGFSANSINLALSGILALVFIVQAVCDGFSTYFLSYAGQKVVASLRERMWFKLLRLPVRYFDEKTSGETVSRVVNDTGIVESLISDHFPQFVSGIITIVGSVVILLIMDWKMTLLMLISVPITTFIMIPLGMKMQRISKTMQDETASFTGHVQQTLSEIRLMKASNAEHTEKMKGLSGISKLFQYGLKEARIFALVSPFMHLVIMIVIVAIIGYGGIRVSEGTMSAGSLIAFLLYLFQIIFPITSFTMFFTQLQKAKGATERIIEIMHSEEEEGQEGLEMDISNLPIHVENVTFTYAGGEPVLRGVSFDVDPGQMIAFVGPSGGGKTTMFGLLERFYEPDSGAINIGETPISKLSMKSWRSQIGYVSQDSPMMSGTIRENLCYGLDHADSIDDQELWKVAEMAYADTFIKQFPEQLDTEVGERGVKLSGGQRQRIAIARAFLRDPKILMMDEATASLDSQSEAIVQQALARLMEGRTTFVIAHRLSTIVNADQIMFIEKGEITGRGRHHELIASHALYREFAERQLT

SEQ ID NO: 4386 - protein, 214 aa, Bacillus licheniformis
MTINIKVYSDYVCPFCFLGKDQLEKAIEGKDVEVEWLPFELRPRPSEQLDPLNDPAKLAMWDGAIKPRIEAWGVNMKLPNVSPHPYTDLAHEGYHFAKEHGKGKAYNDRVYKAFFQEEQDIGDIDVLTSLAKEAGLDEHAFKEALSARTYQDVQRKALQHAYEEAGITAVPTFIIGNERIAGAAAKEVFEQAIEKESRQKPVDGLQCDLDGNNC

SEQ ID NO: 4387 - protein, 139 aa, Bacillus licheniformis
MTLHHFIAADRELPLGSFRDQTEEGLISIVKLDPGYEMVKTKLSKPFVYEATGCLHRPGNDIRALFSYINSNIPEGEDIEVYSCWDGEEDKEKDDRLDFFIDIENLQLGKHVKLDKKKYIDEIAGLFYFEERQLVKIRK

SEQ ID NO: 4388 - protein, 174 aa, Bacillus licheniformis
MSDHKAVHSVQAKAEGKTLVMERSFEAPRELVFKAFSGSVHLESWWGPKGWQTANSRFEFQPDGVWLYCMECRDQNQGEFYGRKSCGKAVFQEIAAPEKIVYTDMFTDEEGNVVPGMPEILNEVYFQERDVGTKLITRSHFSSPKELQQLLDKGMVEGFSSQLERLEDYLKAIR

SEQ ID NO: 4389 - protein, 296 aa, Bacillus licheniformis
MRTEQEIIDLVLKVAREDSRVRAVGMNGSRTNPNVPRTNPNVPKDPFRDYDIVYVVTDMQSFLDEPGWVDVFGERIIMQTPEAMELFPNELGNRFSYLMLFTDGSRIDLILVPLEEKLEYSREDGLTVILLDKDQDLPVIPPPTDREYWVQKPSPQCFADCCNEFWWTSTYVAKGLWRQEILYALDHLNLVRAMLLKMLEWKVGFETGFSLSIGKNAKFLDRYVDQNTWERLLETYPPADYKRVWNSLFKMWELFEETAAAVAEHLNEQYLFAEAEKVRQYLRRVQQLKPDAKEID

SEQ ID NO: 4390 - protein, 315 aa, Bacillus licheniformis
MFSIKKMLQNHYGIDSVNISPEQGGWTALAYQVTDGEAAFFLKVYDKNRASTAKWAALIDDYIPVLGWLGDHTALNGRLPVPLLTTAGEYKCEDDDAVYMLYEYIAGETIGDQPLGKGCVEKLAGIIAELHRYDETIPVKTEGIKEKYDISFLDEMTQWLDHLPCELATLIQPYSGAIRDMMESALSLADDLKCSGRRLALCHTDVHGWNLMKTGGELILIDWEGLKLAPVEADLMFFANQPYAQEFLRVYCETHKGFEIDQNALRFYQIRRRLEDIWEFTEQLAFDIQTEKEKAETMSLLKNELEAIKDSKTGY

SEQ ID NO: 4391 - protein, 239 aa, Bacillus licheniformis
MKNYRTLFFDVDDTLLDFGAAEKSALRMLFEEQQIRLTAEIEANYKRINQGLWRVFEKGEMDRDQVVNTRFSLLFKEYGLEADGVLLEKKYRSFLEEGHQLIDGAFELIKSLRDQYDLYIVTNGVSKTQYKRLQASGLYPMFKGIFVSEDTGFQKPMKEYFDYVFERIPHFSVDQGLIIGDSLTADIEGGRLAGLDTCWMNPGMIANDTGIVPTYQIQKLDELYYILNIEKESAAGHCL

SEQ ID NO: 4392 - protein, 456 aa, Bacillus licheniformis
MANKELKRGLGARHIQMIALGGTIGVGLFMGSSSTIKWTGPSVLLAYAICGIFIFFIMRAMGEMLYVEPSTGSFATFGHQYIHPLAGYMTAWSNWFQWVIVGMSEIIAVGEYMKYWFPDLPAWIPGIIAMAILGGANLVSVKSFGEFEFWFAMIKIVTIVLMIAAGFGIIFFGFGNGGQAIGFSNLWSHGGFFTGGFSGFFFALSLVIAAYQGVELIGITAGEAKDPQNTLRHAIQSIIWRILIFYIGAIFVIVTVYPWDELNAIGSPFVSTFAKVGITAAAGIINFVVMTAAMSGCNSGIFSAGRMLYTLGVNGQAPKFFTKISRNGVPLYGTIAVLIGLAIGVVLNYIAPPNIFVYVYSASVLPGMIPWFVILLSHIGFRKAKGAEIDKHPFKMPFAPVTNYLTIGFLLMVLVGMWFNNDTRVSLIVGVIFLAVVAASYYVFGIGKRASADGNK

SEQ ID NO: 4393 - protein, 432 aa, Bacillus licheniformis
MLAILGFFMMLVFMVLIMTKRLSVLTALVLTPIVFALIAGFGFSDVGDMMISGIQQVAPTAVMIMFAILYFGIMIDTGLFDPMVTKILKMVKGDPLKIVVGTAVLTMLVALDGDGSTTYMITTSAMLPLYLLLGIRPIILAGIAGVGMGIMNTIPWGGATPRAASALGVDPAELTGPMIPVIVSGMLCMIGVAYMLGKAERKRLGVIELKHPAGANETAAAAEDEWKRPKLWWFNLLLTLSLIGLLISGKVSLTVLFIIAFCIALIVNYPNLDHQRQRISAHSSNVLAIGSMIFAAGVFTGILTGTKMVDEMAISLASMIPEQMGGFIPMIVALTSGIFTFLMPNDAYFYGVLPILSETAVAYGVNKVEIARASIIGQPIHMLSPLVPSTHLLVGLVGVSIDDHQKFAIMWAVLAVIVMTGCALLIGSISIY

SEQ ID NO: 4394 - protein, 305 aa, Bacillus licheniformis
MSGDERQSSAPRPPGGPVEIVVPAEPSGGWDLTAQAIQSVLKQKQVIKSEVKIVYKPGSGGDKGWKYINSSDTYTIGMTSSLMLSNYILGQSKLKTDDFTPLAILAKEWQTIALPKGSEIKSGKDLLNEIKKNPGKVKIGFSPGLGNDDQLSFVRAADMYGVDPFNIQYLQYESSEELIQALIRHEIDAASMTLSEAKTYERSGSITLGAVTSDKRLPAYPHVPTWREQGIPFVFSHWRGVLGPKNMTKEEISYWDQVFKKITSSPEWKQKINEQEWESYYLNSKETQRFLEEQSAFYQNIMAGD

SEQ ID NO: 4395 - protein, 226 aa, Bacillus licheniformis
MIDIVIAEDDFRVAQIHERLIEQLDGFNIIGKAANAKETMEILEVRKADLLLLDIYMPDEMGTTLIPVIRKRFPEVDIMIITAATETCHLQESLRAGIVHYLIKPVTAEKFKQVLLQYKKKRQTLLSQPQVSQSMIDQIFGDFSSGSRQAEDLPTGINSITLQKIRDVLRDAAKGMTAEKLGEKMGASRTTARRYAEYLVSKEEARAELEYGIIGRPERKYYLADE

SEQ ID NO: 4396 - protein, 538 aa, Bacillus licheniformis
MPVVKKRVNFSLQTKIMGLIAALLILVIGLLTVTFAVQQTKEGRKQSEQLAVQTAKTISYMPPVKELFQKKRGHKGEAQEVIEQMKEQTGAYTIYVLNEKGEIKIASEKRGQTKLTRSRKILFGGSHISKTKNDGRMVIRGSAPIIQEQSGYSKVIGSVSVDFLLNETEQRIKENVRKLSFMAVLVLLIGFAGAAALAKSIRKDTLGLEPQEIASLYRERNAMLRAIKEGIIATNREGVVTMMNVSAAEMLRLPEPVVNRPIDDILPGAGIMSVLQQRQMLLNQEVCVNDQVFILNTKMMLQNGQTYGIVVSFRQKTELKRLIDTLTEVQKYSEDLRAQTHEFSNKLYVILGLLELGEYEAAIDLIKEEYAIQNEQHDILFKNIHSQQVQAILLGKMGKASEKKVKLSIDENSTLEPLPEHIGMSHLITIIGNLIDNAFEAVAEQNVRLVSFFITDIGRDIVIEVADTGCGVAPDKMKAIFERGYSSKGMKRGYGLANVKESVRELGGWIEVANQKGGGAVFTVFIPKEKQTREGESI

SEQ ID NO: 4397 - protein, 298 aa, Bacillus licheniformis
MNLHALRLFYSVAETGSVTQAAKQLSISQPAVTSQIKKLEREIDCTLFVPKGRGILLTQSGAELAKQAKRLFSLEKEIESYVEQLREGSIGKLRIASTFLPANYLLPRWLSRFKQQFPKTEVEITTTNFQKACEQLINYEADIGLIGGTTEFGPFLKGTLLLEDDMLFVVNQKHKFASKHVALEEIVKEPFVFREEGSFSREKLISLCNLHNAGKPNMGVQINGLNETIRTVMEGYGVTFVSALEVNEYIARGDIAKVHVDKAVIKNPISLCVRTEDHLSPSALNFIQMIDSTDEYPL

SEQ ID NO: 4398 - protein, 405 aa, Bacillus licheniformis
MSTLILNKTAYSKSPYDVWLKGLDEPVAMLTSTDRADECRNYDVIEAFDDYPVNGCIEMRALELNETYHFKTIIASSEFDMLRAGKLRSLLGIKGQSYKSALLFRNKILMKEQVRKAGVKVPDFKKIDSAADLYTFVQTFGFPVVVKPIYGSGSVDTTVLRNRQDVWNVLAKGLPDHLEVESFIEGDMYHIDGLILDEEIVLSWPSRYINGCLAFQDHQFLGSLQLELKNPLTRRLTDFVQKALAALPVPNTTTFHAEVFHTPDDELVFCEVASRTGGAMVREATVQTFGFDINEVCVKAQCGLEFHIPEVDNNPDRLSGWLLIPPKDGVLKEIKPAPAADWIAKQNISAQAGDRFHGSSSSVDAIASCLIIGRTEAELRGRISRLATWFHDHTVWEKNSDVCAI

SEQ ID NO: 4399 - protein, 408 aa, Bacillus licheniformis
MFAQFKAFSRLHPLIRFLLIGTLVTKAAKSMTTPFLALYLHMKTGADFGTIGLVIGLGYFSSTVGGVVGGALSDKIGRKKVMLSSIFIWSFVFILFGLVHDFMWFLLLNILSWLCHSCFEPVSKALMAELSEREMRFRIFSLRYLAINVGAAVGPLLGAYFGLAKTGTPFIITGLVYFGYAILLSLMMIRLTTVKETKIAPEKVQAGSVLKTLKQDKALRLYIAGGILFLFSYSQMESTLLQYLNNDFANGVKIFSTLITLNAVTVILLQVPLTRLFERYKSLTTISIGTVFCILGNIGFSIANGWIVFMLSMFVLTIGEILCFPSMNVLLDELAPDHMKGAYYGMQNLYNIGEFLGPWLGGMMLALYGGKAVFLIAACSVFLALGAYHVGRRKFLSAQHYGVSPFSY

SEQ ID NO: 4400 - protein, 82 aa, Bacillus licheniformis
MDTTLGYLRESLSNHLEHGIGQNIYRKIVSGRYANEEEFVEHLEEREMEFLNQVLEHEMKYALNEQDHKRTRELNEVYELLF

SEQ ID NO: 4401 - protein, 63 aa, Bacillus licheniformis
MGAIERNGYTFEPEYSVTRQNGAIHVYRRGRFVEEIPFEFHGEFPEHDLIEELVNHYCYENKI

SEQ ID NO: 4402 - protein, 90 aa, Bacillus licheniformis
MTMKQKNLISGLAVVAGVTAYMLKDETNRQKLKSYLQNVKEKIPYFSEKHNVDSFPVEKAGHPSPHDIEDNKMVSEGSMYPVQYYDEKKK

SEQ ID NO: 4403 - protein, 625 aa, Bacillus licheniformis
MAHESFEDEEVAKLLNEKFVSIKVDREERPDVDSIYMTICQMMTGQGGWPLNVFLTPDQKPFYAGTYFPKTSRFNRPGFVEVVKQLSDTFAKNREHVEDIAEKAANNLRIKAKSDAGDSLGEDILRRTYQQLINSFDAAYGGFGSAPKFPIPHMLTFLLRYHQYSGEENALYSVMKTLDSMANGGIYDHVGYGFARYSTDDEWLVPHFEKMLYDNALLLIAYTEAYQITKNERYKQISEQIITFVRREMTDEKGAFYSALDADTEGVEGKYYVWSKEEVLETLGDELGELYCAVYNITQEGNFEGHNIPNLIYTRLEDIKDEFALTDEELQNKLEEARTKLFEKRQERTYPHVDDKVLTSWNALMIAGLAKAAKVYNAPEYLEMARAAAEFIENKLIQDGRIMVRYRDGEVKNKGFIDDYAFLLWAYIELYEASLDLTDLRKAKKLEADMKGLFWDEEHGGFYFTGSDAEALIVRDKEVYDGALPSGNGVLAVQLSRLGRLTGDLSLHDQAAKMFAAFHGDVSAYPSGHTNFLQGLLSQFMPQKEIVVLGKRNDPDRQKIVSALQQAFQPNYAVLAAESPDDFKGIADFAAEYKAVDNKTTVYICENFACRQPTTNIDEALDQLV

SEQ ID NO: 4404 - protein, 53 aa, Bacillus licheniformis
MPNKSKPNRLIAEKSPYLLQHAHNPVDWFPWGEEAFDKAKSENKPVLVSIGYS

SEQ ID NO: 4405 - protein, 639 aa, Bacillus licheniformis
MSESLIKVQFKEGNTKEFPKGITIKRIAESISTTLRKHAVVAKVDEKFVDLSYTLDKDVKLDIFTLDSKEGLSVLRHTSTHILAHAVKRLYSSVSLGIGPVIEDEFFYDLKLEHSLSPEDLLAIEREMEKIIKENIEIKRIVVSYEEAEKLFEENNEPLKLEILRGIPKGQEITLYQQGEFIDLCRGPHLPSTGFIKAFKLTRVSGAYWRGNRQKEVLQRVYGVAFKKKDDLNEYLYFLEQAAKHDHRQLGKQLDLFMFSEEAPGMPFYLPKGQIVRKELEKLSRELQNNASYDEVHTPFMMNYRLWEKSGHWDHYQENMYFSEVDNTKFAIKPMNCPGHMLIFKNNLYSYRDLPIRLAEYGQVHRHEFSGSLNGLLRVRTFCQDDAHIFVREDQIESEIKKVFHLIDQVYRTIGFEYSVELSTRPDDSLGNNHLWEVSEGSLKNVLDDLAIKYQVNEGDGAFYGPKIDFHIKDALKRSHQCGTIQLDFQMPEKFDLTYINHNNEKVRPVVIHRAIFGSIDRFFGILIEHFAGVFPVWLAPIQVQIIPISHIHLEYCLGIKSELKQHGIRVQINESNQKLGYKIREAQVQKIPYTLVVGDNEIKENGVNVRKYGEEQQKNVSIESFKKNILQQIKTRSV

SEQ ID NO: 4406 - protein, 224 aa, Bacillus licheniformis
MTLLKKQYEMFKCVTDENYLKEYKKQNHFDWVNFDFFRKLHFNKRAIRFNHVFPKTKEKTREWEKFVKNFCNQHNYTGQRVEEDADSFVNFLSKKKGNESYIAQLAKHELNIYLVTIGKGNGFVDAFCYPITCFNITSTETKKHNYLYIKGKQGVRVFKIEQSVAIWIENYKNLLCIKEATNLTHNSLNTQEKNQLKIAIDNFKKLGLLDIWKRESINEKSKQH

SEQ ID NO: 4407 - protein, 396 aa, Bacillus licheniformis
MKSLNNIKNKIVIVGTVDSLGAAIVWTGLPLYAYSITGSFLYTSSLFFTSAIARILATFFGGYLADVSSSKRIMLRCLSINWFFYSLLFLGLSLGLTWIIFPIMLISQCFSTISIMNQNLWFNSLCSKETLASEISGRNSWFLISKTVGFSLGPLMYHWLNAYSLIINLLTILIAITLILTIKDLGYVNNKKKKESIFSSFKEVYKNQLLKRLNIIEILNGLTFPVLTSLSIYILEKNLNASSLIISLFWLIGGVGAITANLMLSRLKLFKLQYIHQFIISFVLVVGGLLLMTIASYSFVYLIGFSLFTLGTPIINNLLRSKVFIFAPSHMKGKVTSVITSSSDLGTIIALSLSWIVVEKFGVLIFMSFVILTSVSRICLFFYTLHKVENKVDVEG

SEQ ID NO: 4408 - protein, 272 aa, Bacillus licheniformis
MSNCIGVGLSFRQNFFKDLDVIKQDVDFLEIISERYFDKKNEEELNTIRNYFPLIPHGLSLSIGTYEPLSKKKEKQISNLLAELQINSYTDHLAMSSVKDIELLDFFPVMYKEETFEFLINKYDQLKKGRLKNLYLENITYTFNWHNNDFSELDFWYKLLNETNIGMLLDVSNLYINSINHKYDPYAFFDKLPKDKINYLHVAGFIRNKYGFLIDSHSEPVHKEVWKLAEYIIKKAPVKGVILERDLNYQNYHDVKNDIKIIKSLVYKYQTN

SEQ ID NO: 4409 - protein, 103 aa, Bacillus licheniformis
MTAINLIIFAVLIALTAFFVATEFAIVKVRATKIDRLILEGKKGAVSAKKVVTHLDEYLSACQLGITVTALGIGWVGESTFEVILHPIFAYFNVSEQVTHILI

SEQ ID NO: 4410 - protein, 398 aa, Bacillus licheniformis
MSLSQIFGGAGLAAGITVGALLAKQMLGTDAFSGVPSALFTLGSAGAAFGVGRLSQRYGRRTGLTAGFMVGGIGAIGVVAAAVINSIILLFVSLLIYGAGTATNLQARYAGTDLADKKQRAKAISVTMVMTTFGAVAGPNLVDVMGKFASIIGVPPLAGPFILSAAAFILAGLVLYILLRPDPLEIAKKIETYRQENKLADESKSAGASDDQKGITIGAAVMVLTQIVMVAIMTMTPVHMQHHGHSLGDVGIVIGFHIGSMYLPSLVTGILVDKIGRTAISIASGVTLLLAGAVAALAPSDSLVLLIVALSLLGLGWNFGLISGTAQIIDSTEPSTRAKVQGTLDVLIALAGASGGALSGMVVAHSSYAVLSLAGGLLSLALIPAVIWPRRKTNTQKG

SEQ ID NO: 4411 - protein, 210 aa, Bacillus licheniformis
MKNQKVLDAGCGEGYLSRMLAAREAVVTAVDYSTRMLEIAKERTPDGLHIHYRHGNCEDLHFLDEQSFDIIISNMVIQDLANDEKAFQEMHRLLKDGGCFIFSILHPCFVTPESGWERTKDGQKLHWNVDRYFYEGAYEQPLGGEEKMFLFHRTLTSYINTIIKAGFQLEAVEEPRPSKEMLKKYPSFEEDLRCPDFIVFKLRKPGGDVR

SEQ ID NO: 4412 - protein, 148 aa, Bacillus licheniformis
MERIWLFLLPGIDHSIGRCLGIAPEKVPAHYNALGEVDRWGSKWELFILPGIGLIILLFMQFLEKHPEIHNHPKRLNETNAEHFYLLSRKLINRLKNACLIIFSLILIESVSIALDWGSGFGGWFLPIALLGTVMLVAIGLIQQRKIK

SEQ ID NO: 4413 - protein, 481 aa, Bacillus licheniformis
MEIDVQKLLFEFIGGLGIFLLGIKFMGEGLQKSAGDKLRDILDRFTSNPLMGVLAGMIVTVLIQSSSGTTVITVGLVSAGFMTLRQAIGVIMGANIGTTATAFIIGFDVGAYALPIIAIGSFLLFFLKSKKFQNIGQILFGFGALFYGLELMSSGMKPLRTVEAFHDLTVSMSANPILGVLVGTLFTVLVQSSSATIGILQGLFADSLIDLNGALPVLFGDNIGTTITAVLASLGASVAAKRAAAVHVLFNLIGTAIFLILLKPFTALILMLQSSLGLDPKMVIAFAHGIFNTSNTLIQLPFVGILALIVTKLIPGKDSVVDYKATHLDPLFIQQSPSIALGQAKEEVLRMGEFAVKGLEETKEFFNTKQAKHAQSAFQIEDAINNLDRKITDYLIELSATTLSEQESEEHHMLMDTVRDIERIGDHFENLVELGEYQQSNRVKISEAAMADLTEMLDLTISTVKSPSPLLGKITKMPQDA

SEQ ID NO: 4414 - protein, 86 aa, Bacillus licheniformis
MHKYRRRNTTAFTVMSYFTFFAGVFLFGIGLYNADNLQLNEKGYYIAVMILVAVGAILTQKVTRDNAEDNEIIAEQERRQNLSSGE

SEQ ID NO: 4415 - protein, 148 aa, Bacillus licheniformis
MRNEKQLFQKAEHTAKLLESHKSDEELLTYLANQESVTLNQLKIYFSNPSFTLTYLIKGIFFSSMTAVIMAAFLSGQISSLNHGLSRLFSFFFMFYLIFSFLWIVKMLISSRKGPMQTILHFQKRAEYSRITGMIDFILDERFKKEFN

SEQ ID NO: 4416 - protein, 139 aa, Bacillus licheniformis
MREETKCALIIDESLPLGLIANTAAILGAALGKNKPDLIGETVTDGSGIDHLGIVKIPIPILKGNAELLHQLSQKLLTDEFNDILTVDFTDVAQSIHTYEAYIEAFQSTAASDYRYFGIGICGDKKKVARLTGSLGLLR

SEQ ID NO: 4417 - protein, 302 aa, Bacillus licheniformis
MKTRRETAGHLAAVITIIIWGTTFVSTKVLLEDFPPVDILFYRFLIGLIVLIMVHPHVLTFRSWRQEALFAGAGLCGVTLYFLLENIALTLTYASNAGMIVAVIPMITAVLAHFLLSGEKLEPRFFIGFAAAFTGLALIFFNGQMMLKLNPLGDILAAASAFVWAAYAILMKKISTFGYHTIQCTQRIFLYGLLFMVPALFLFDFRFDASPFSSPVNWLNILFLGAGASALCFVTWNWSVGVLGAVKTSAYIYMVPVITIAASVIILQEKLTWVAFCGGALTLAGLYISETKPKPQLKEEQI

SEQ ID NO: 4418 - protein, 146 aa, Bacillus licheniformis
MRNETRTLFLDPDLNVEAYRFKGIIQKFPNHFHEYFVIGFIEKGQRYLLCKGEEYIINQGALVLFNPYDTHSCEQIDGKALDYRCINVMPDVMRGFVKEITGADSLPYFTENVLFRHELNASLKELHIQILQKEKALKKEELCHVS

SEQ ID NO: 4419 - protein, 137 aa, Bacillus licheniformis
MKKKWIASIAFTMMLGIGITIYCLFFEHSKLSELTSDGEWELSYSKERGDQYWNGYVSKKTSEDAELKRVVFFVNGKETVDYEKDEQEEGGTHSDIVNVVWLGDAPEKSEQFEAVVERNQNGEYHKERIKLTAKNGL

SEQ ID NO: 4420 - protein, 155 aa, Bacillus licheniformis
MDKEYITELISSKLRLIRAESGYTQEKMANVLGMSKKTLVQIEKGRSAAGWAHVVAVCALFRNSEVLQAVLGDEPLEVVETVAHRSIDRPKGKTLGGKVWWRDIEKKGEFRLQQNLISHHYRILDSYDDLWFSTFEKQDAVARLDELLNEQDGVE

SEQ ID NO: 4421 - protein, 205 aa, Bacillus licheniformis
MFTEKDQSLLASLAPLIGRHLQQFRHHLPKKDVFHMKHVGGILILSEDLQLLSCNRAALHWLNILRGWESIGSEAVPRPVRAVCTRAAAETTAPAKTVISIPGHSCLSIKASRLDGFGPSGQIAVSFEPASPAETIPLIAEAYSLSDREKDIAYRVIRGLSTKAIGDELHISAYTVQDHLKSFFLKTGAGNRRELMWKLLDDVLE

SEQ ID NO: 4422 - protein, 351 aa, Bacillus licheniformis
MQPEDIVRSGPNQYVCREGIVKELPSFANAFERPVIISGVKSFKAFTRYTTPPADWKVVQHTGCSSLNKIKKAAEEAESADVIIGIGGGTVLDTAKAAADLLNIEVMTIPTIPGTCAASTPLSVIYDDEGNFSGVQYQKRSSYLTLVDPLLLLSSPVAYVKSGIGDTLAKWYEAEAIIRNTADSLSIMVQTGLRQSVYIRDILLTESLKAIESLEKGESSPAFTNVLEAVIALAGTVGGYAGRYGRMAGAHAIHNGLTFIPETHRVLHGQKVAYGILVQLALEGRTDEIAELIPFYEGLGFPRRLSDLGILENIEAAKRIIAAHAARPDESLCLMGSFHEADVIAAIESLE

SEQ ID NO: 4423 - protein, 568 aa, Bacillus licheniformis
MKSPRWNNITIGGKYGIIFFVMLTAFLTSVLITYGLLKDTSQTVQDTKSKNETAVQSAKLMSLYQNKYLHIPEYIINAQDEKLTDYMKYSQEFADTAKKLKKELHSDEQLDMFDQIIENNHSLDEYFFSEIVPNVQQINTEKFLTLQKKANKLKEETMTLGESLKENAVKTNVESIGQAQSNMTKTIYILGVSILISAIVSAGLLIIVSRQIKKNLKRVVAASEEIAKGHLNFEALDYKGKDEIGQLSQAVNHMGGSLREMIVEVSGIAAEVDKQCLTFTSVSADVREGSEQIAVTVEELANGATNQANEAANISEQTQELTGQIQHAHESGETLARFSKEVLHVSVDGDKQMAQSLEQMNVINHVMEASVEKVSVLEEQTQSIHKLVEMITGMAEQTNLLALNASIEAARAGDAGKGFAVVAGEVKRLAEEVKSSVGSITEIVTAIQTETSSMAGDLKTGFSEVHKGKNQIETSGRYFSEIKNKVTDMAGRVSDISEALSHFRRSSEEINGSVEHIAAISEESAAGSEEISASVHEQSGSIEKMDESARLLGEMVERMNVMIKRFKL

SEQ ID NO: 4424 - protein, 354 aa, Bacillus licheniformis
MLSIYVKRGLLALALFSLLTAVAGCSFNSAEKSANREEKVKLIADSDKLYVGFAIDTLKEERWYKDKEAFEKEVKNLGGEVKTLAANGNKEVQIQQAELLISEGVDVLVVVPADADAAAEIVKKAHSAGVKVISYDRLIRNADVDYYVSFDNEKVGELQAEAIVKKAKKGNFVYIGGSSLDNNAVLFRNGAMKVLEPLKRQGKVKLVLDEYTKDWLPEEAKKNMKKALNKTRDIDAVIAANDGTAGGVIEALQEAGLAGKIPVSGQDAEIQGVRRIVNGTQTMTVYKPIPALAKKSAEMAVQAAKGEAIQTDTTVENGKAKVPAILLEPYAVTKGNINETVIKDGHLSKKDINK

SEQ ID NO: 4425 - protein, 255 aa, Bacillus licheniformis
MKKSISSLMIGLLAVVLGACSSNHDDQQSQASDQAKTAQSGQQDQEKQIKAMQKKLDQQKVDDTKTVAVVNDEKITGKDYNSVLSTAQMQYQQTGQDPTSKDAAQQIKKQAIDSLIGQALITQEADKKGYKASEKEIEKQLDESKKQYKNEQDFEEAVKKAGLNMNTLKSDIADSIKTEKYIDKELPTDQVTDKEIKDYYDQFAAQQKDSGQKNTPAFDDVKQQIQDMLKQQKRQEKLGQQVEKLKKSADVKVEI

SEQ ID NO: 4426 - protein, 254 aa, Bacillus licheniformis
MFEDERLNRLIYLYTPLYAEDFPIILFWIPKSGCTTLNRWFFFQNGLLEDVNRRCAGEVHHYRNAIYTQKPNYVKDLLTDLREGKKDTYKVVRNPFRRAVSSFLAAICSPNFICLFNSDINTGLSFTQFLHHLKDLGTDINAIDRHLGPQYIEGEEEFVTNYIYLEQFSAQIREIENKYKLLKSPLSQLSQSPHHLSDIMIKKGKFADTVLTMSTFDWAFPTFESFYNDETKELVHDIFAKDFEVYGFDSKHIK

SEQ ID NO: 4427 - protein, 295 aa, Bacillus licheniformis
MQIRMTEYQVPDPESGPYGITVCANGRIWFTEQKGNRIGMLTESGDITEYTIPTESAGASIITSGIDGELWFTEYKAGKIGKITPQGKITEYALPPGAAPFGIAAGCDDAMWYTDMAGHQIGRLSSSGEITEYKLPKPGAFPSFITRGADGALWFTQNQSGSIGRITADGDISEYPLPQEQSGPVGITAGPDGALWFTEINANQIGRITVSGKISEYQLPTAHARPHAIAAGGDGALWFTEWGAGQIGRITVDGDITEYPIPTADSEPHGIAAGSAHSIWFAEECGRIGKISIQN

SEQ ID NO: 4428 - protein, 126 aa, Bacillus licheniformis
MEHVKALAIKGIMTIVILYLVLGLGFSFSFENTLFITIVLGAVSYLLGDLFILPKTNNITATLADLGVAFLVVWLMALAMGTAANTAALAAFFAAVAMAIGEYIFHFYLMNKGLGSPNRRMETRTE

SEQ ID NO: 4429 - protein, 484 aa, Bacillus licheniformis
MEQSNTNRQNFQRKMQTRHLIMLSLGGVIGTGLFLSSGYTISQAGPAGTILAYLAGALIVYLVMLCLGELSVAMPVTGSFHMYASRFIGPGTGFTVAWLYWLTWAVALGSEFTAAGLLMQRWFPDTSVWMWSAVFAALIFALNAVSVRFFAESEFWFSSIKVLAIILFIILGGAAIFGIIPIQNADAAPLLSNFAGEGGLFPNGFLPIFMAMLSVNFAFSGTELIGIAAGESAEPEKNIPKAIKTTLWRLVLFFIGTIFVLSCLIPVKEAGVIKSPFVDVFDRIGVPYAADIMNFVILTALLSAANSGLYACSRMLWSLSKEKTLHPVFQKLTSRGIPLNALIFSMLGGILSLLSSVFAPDSVYIVLVSISGFAVVAVWMSIAASQFMFRRRFLAEGNTADDLKYRTPLYPAVPIAAFLLCLASCIGIAFDPNQRIALFCGVPFMALCYTIYYATNRKNSWNPSEPVKNASLHVSFSEYEEKKN

SEQ ID NO: 4430 - protein, 315 aa, Bacillus licheniformis
MTNPIRTSLQQFSVIILDGAMATELERYGCDLNDSLWSAKILIENPELIKQVHLDYFRAGADCAITASYQSTVEGFTKRGLSEQEALHLIRESVRLAAEARDEFWAAPENREGRPKPFVAASVGPYGAFLADGSEYQGNYGVTEDELADFHRRRMGALIEAGADILACETIPCLSEAKAIVHLLKEFPDTHAWISFSAKDGRHISDGTKAGECAKWLDQHDQVAAVGVNCTRLEHVSSLIGGIKKHTAKPIIVYPNSGEQYDPETKTWHGAACKASFGESARSWYNQGAQLIGGCCRTTPEDIKAVAAWARKLEV

SEQ ID NO: 4431 - protein, 246 aa, Bacillus licheniformis
MKKLIINADDFGYSRGVNYGIIDAYKLGILTSATFMTNMPGAGHAARLARESPGLGIGVHLVLTCGRPLLSDHRTIVDSKGSFRNLAFYQGAFTIDADEVYREWKTQIETCINMGLKPDHLDSHHHINAYPGISDVFLSLAKEYRLPVRRNMESAIITEKGVKTTDSFSPVLEAALKGEEAVSELFEKHNTVEVMTHPAYLDKELLTNSSYTYPRVDELEFLTDPDVVIRLNKLADVQLVSFRNLT

SEQ ID NO: 4432 - protein, 457 aa, Bacillus licheniformis
MKHILQLLGKSLLIPITVLPIAGLLLRLSAEDMLDIPLFQASGVILNNMDVLIAIGIAMGFARSKDKGIPALTGYLAITVLKEGIGILNPDLDMSVFGGVLAGLMAAFIYNQFQHARLPSMFSFFGGEKFPITMIVLVTIPVAGFFSVVWPYAEAAIDAFSQSLVGLGAFGVFVFGFLNRFLLPFGLHHVMNTYIYFGLGRYETASGEAVTGEITRFLNGDPTAGYFLGGFFITMMFGIPAIALAIAHAARTRKKETKALMSSGAATSLITGITEPVEFTFLFTSPLLYFLHSVYTGLAGAVLCLLGIRHGFSWGAGAIDYLLNLNLSDGGLLIIPVGVAFFALYYVTFYFVIIKRNVPVIGREQETPEGDRLQQSMAAGILKYMGGRENVVTCENCITRLRLKLKDTSLADEAQLKRLGAHGVIIIDRHHIQIVIGTDAGTVKKDLQNLIDESAPD

SEQ ID NO: 4433 - protein, 258 aa, Bacillus licheniformis
MKKDEYYSIGVFSEMTGTSIRTLHYYDEIGLLKPEKETGTGRRLYTDRDAKDLQKIICFKFLGYSLEQIRAFMKDACFDAGLIEALQEQKRVLEERKEHIETGLKAIDRTIGLLEEEEEIDSSVFMSLLNSIQTEKEQREWLEQQVSKSFADDVFGKSEEEMAKLDQEYVRLSKEAKRLMGKPVDDPEVQDMADRYMKTSLEFVGEGVLSALGQMETIESRQLAEKFPSPFTKEEEEWLQRVFEYYMIHNDFCPESGG

SEQ ID NO: 4434 - protein, 240 aa, Bacillus licheniformis
METVKEILVVYGRIITILPLLLVVTLFMGKRSIGEMPVFDFLIIITLGAVVGADIADPKIEHLHTAAAVAAIALLQRLASNLMIKYRTLGRLITFEPTIVIKNGTFIVGNLKRIKYSVDNILQMLREKDVFNVSDVEMAFVEANGNLTVYKKPNKMEITAEDMGIQKSSGEFSYPVIVDGKVYTSVLQQLNVTESWLKNQLKKKGLERMDEIFFASVNQNHELHVSLDNQTTKIEPELLH

SEQ ID NO: 4435 - protein, 236 aa, Bacillus licheniformis
MKLSSKLILGLTVSSLAGKFLEKLLIQDNVSPNITASFNQEADIPDIDASSYIHHFASVIGSVVIGRNVFIGPFSSIRGDVGLKIFISHDCNIQDGVVLHGLKNYEYNSPVTEHSVFKDRESYSIYIGEKVSLAPQCQIYGPVRIDKNVFVGMQSLVFDAYIQEDTVIEPGAKIIGVTIPPKRFVSAGRVISNQEDANRLPEITDSYPYHDLNSKMTSVNLELAKGYKKEERQWKL

SEQ ID NO: 4436 - protein, 132 aa, Bacillus licheniformis
MNMKRSRIGRLALTFAAMAAGLASRKTADMLPDIVNVYLGDALWALMIFFGAGFLFKNAKTASAALIALVFCFMIECSQLYHAPWIDNIRAAPLGGLILGYGFLWSDLLAYVLGVSAGAAGEMLFRKRKRQP

SEQ ID NO: 4437 - protein, 476 aa, Bacillus licheniformis
MQQFLQEVIGVTNDFLWSKLLIIMLLASGLFFTFKSKFFQVRLLKDMFRVLKEGTPDKNGISPFQAFCISMAARVGTGNITGIAIAIALGGPGAIFWMWIIAIIGSASSFVESTLAQIYKIKDKDGFRGGPAYYMEKGLKKRWMGAVFAVLITLSFGIVFNAVQSNTITVAFENSFGTDRLTLGIIITIVFGIITFGGIKRIAKLSEYIVVCLAVLYIGVAVFVMLMNITKLPDVISLIIGHAFGLEQAAGGAIGAALMNGIKRGLFSNEAGMGSAPNAAAAATTSHPVKQGLVQALGVFTSTLVICSSTAFIILFSDAYKEPGLSGIELTQASLSTHIGAWASGFLAIMVFLFSFSTLIGNYYYGETNIEFLHTNKAWLFIYRICVLAMVIFGSVSKVQLVWDLADLFMGLMVIVNLIAIFLLSKVAFAALKDYVKQRKAGKDPVFYKDVIKNHEGIECWEHSGTEQKSESKNAI

SEQ ID NO: 4438 - protein, 327 aa, Bacillus licheniformis
MNEVLEERYDARFWQSRLEDLVEHYRPFSSSGRNAEYIPALGKIDSNQLGICVIGSDQTMIKAGNSDVSFTLQSISKVISFIAACLTKGISYVLDRVDVEPTGDAFNSIIRLEMHKPGKPFNPMINAGALTVSSILPGESALGKIESLHDVIEKMIGKRLEINEEVFRSEWQTAHRNRALAHYLKETGFLEADVEETLEVYLKQCSMEGSTEDIALIGMILANDGYHPFRREHVIPKDVARLTKALMLTCGMYNASGKFAAFVGIPAKSGVSGGIMCAVPASVKREQPFQHGCGIGIYGPAIDDYGNSMTGGMLLKHIAREWDLSIF

SEQ ID NO: 4439 - protein, 442 aa, Bacillus licheniformis
MMGGNRGSVMTKAARLVKKDGYILMVMMLTVPLAGELKFYPLNETFRVSFGVPTFFFLLLLLRNVPAVLSGFLTGAAVVGFRVLLDGFGPGQIDWLSSFYYHYPTFFFYFTYAFLFYLAKVKRFQFRPLYIGFLGFGIELIADGAELAVQYMMFESTVTPGKIRDMMAIAFSHSFIVLSFFNVMKLYETQSREKQIREQNEHMLMIVSNLYEETVHLKKTLKNTEEITNESYQLYRLLNRQSDNNSSVRQISQKVLRLAGEIHEVKKDNQRIFAGLSKLISKESFRDYMAAEDLVRLVTGINRKYAESLEKDIDFHYSIDGEHPKYHVYTVLSVINNIMANAVEAIQKQGSIRLSLYRRGDDMLECRVEDDGPGIPEKVGDVVFEPGYTSKYDEFGTPSTGIGLSYVKETVEELGGSIRFRNDASGVVFTIRLPVQQLIQKG

SEQ ID NO: 4440 - protein, 311 aa, Bacillus licheniformis
MRFFIADDDRAVRSILKQIIEDEDLGEVAGEAEDGCDLEGHVLNLQQIDILFVDLLMPLRDGIETVRHLHGVFSGKIIMISQVESKEMIGEAYSLGIEYYIHKPINRIEILNVIQKVKERIELERSIHDIQSSLNRLVSLGGGGKNGFREKSIQETGEFLLSELGIVGESGSQDLIAILQYLFDDEQTSLYEKDFPPLKQIFHQIAVQKLGPAASPAEINREVKASEQRIRRAVSHSLNHFASLGLTDFSNPRFESYASRFFDFTVISKKMKELQKDSAAVLPSARVNTKKFIQVFFLEAKRLSESAGKRG

SEQ ID NO: 4441 - protein, 178 aa, Bacillus licheniformis
METLYTERLTLRKMELEDADVLCQYWSDPEVTKYMNIAPFTDVSQARDMIQMINDLSLEGQANRFSIIAKETGEVIGTCGFNMIDQENGRAEIGYDLGRNHWGKGFASEAVKKLIDYGFTSLNLNRIEAKVEPENTPSIKLLNSLSFQKEGLLREYEKAKGRLIDVYMFSLLKREYAG

SEQ ID NO: 4442 - protein, 599 aa, Bacillus licheniformis
MSSSFFIPFLVSQILLSLFFSLIILIKKLLKAQITVGTHYHLSVISLLALIAPFLPFHYLKSNHFDWILNLGGASSTLSHTRSTDKTAEAIGQHANWVQDFSMSIEQSSFKMIDSAFFAVWILGIAVMLIATLYSNRKIGKIKKSLQMVNNKELLTLFRTCKEEIRFHQKVILGCSPLIKSPITFGVVRPYIILPKDISMFSADEMKCVLLHELYHCKRKDMLINYFLCLSKIVYWFNPLVWYLSKEAKTEMEISCDFAVLKTLDKKLHLKYGEVILKFTSLKQRTSSLVAASEFSSSYKHIKRRIVTVVNFKAASPLLKVKSALVFALVLGIILAGTPSVSILTMQRDTHFLSGANVEYEDDSTFFDGFSGGFVLFDSNRKKYTIYNRKESTARFAPASTYKVFSALLALESGIITKNNSQMTWDGTQYPYKEWNQDQDLFSAMSSSATWYFQKLDRQIGEDHLRRYLKSIHYGNEDFSGPANYWLDGSLQISPLEQVNMLKKFYDNEFDFKQSNIQTVKDSIRLEESNGRILSGKTGTSVINGELHAGWFVGYVETAENTFFFAVHIQGEKRAAGSTAAEIALSILDKKGIYPSASR

SEQ ID NO: 4443 - protein, 128 aa, Bacillus licheniformis
MKKIPQISDAELEVMKVIWKHSSINTNEVIKELSKTSTWSPKTIQTMLLRLIKKGALNHHKEGRVFVYTPNIDENDYIEVKSHSFLNRFYNGTLNSMVLNFLENDQLSGEEINELYQILEEHKNRKKE

SEQ ID NO: 4444 - protein, 307 aa, Bacillus licheniformis
MKLWFSTLKLKKVAAVLLFSCVALAGCGSNHSNASHSAEKDEKTEMKDDFAKLEEQFDAKLGIFALDTGTNRTVTYRPDERFAFASTIKALTVGVLLQQKSIEDLNQRITYTRDDLVNYNPITEKHVDTGMTLKELADASLRYSDNTAQNLILKQIGGPESLKKELRKIGDEVTNPERFEPELNEVNPGETQDTSTARALATSLQAFALEDKLPSEKRELLIDWMKRNTTGDALIRAGVPEGWEVADKTGAGSYGTRNDIAIIWPPKGDPVVLAVLSSRDKKDAKYDDKLIAEATKVVVKALNMESK

SEQ ID NO: 4445 - protein, 583 aa, Bacillus licheniformis
MTHEGPLEEWMKKLSEESLKDNTFDRRRFIQGAGKIAGLSLGLAIAQSMGAMEVNAAPRFSEYPFTLGVASGDPLSDSVVLWTRLAPDPLNGGGMPNEAVSVKWELAEDERFRRVVKRGTEKATPHLAHSVHAEVSGLKPNHVYYYRFKCGNQLSPVGKTKTLPAPGADVAKFTFAFASCQQYEHGYYTAYQHMAKEKLDLVFHLGDYIYEYGPNEYVSKTGNVRTHSGPEIMSLLDYRNRHAQYRSDANLKAAHAAFPWVVTWDDHEVENNYANVIPEKGQSVEAFIKRRAAAYQAYYEHMPLRRQSLPNGPDMQLYRNFSYGNLADISVLDTRQYRDDQANGDGNKPPSDESNDPKRTLLGAEQEAWLFDNLSRSEAHWNIIAQQIFFAQWNFGTSAAPIYSMDSWDGYPAQRKRVIDFIKSQKLNNIVVLTGDVHASWANNLLVDFDNPKSDIFGVEFVGTSITSGGNGADKRADTDKILSNNPHIKFFNDYRGYVRCTVTPEEWRTDYRVVPYVTEPGAAVSTRASYVYHKDYTGLKRTASNIVPGGVKKSNEVEEDRFLAHTRAHQKQVKQKEKKVTQ

SEQ ID NO: 4446 - protein, 70 aa, Bacillus licheniformis
MLSNIGIPGLILVLVIALIIFGPSKLPEIGRAFGKTLTEFKSATKSLVSADDNEIGQGSDAKKQSDPSAR

SEQ ID NO: 4447 - protein, 244 aa, Bacillus licheniformis
MKKRETHLIAHLEELRQRIIKTLLTFILFLITGFLFVQDIYDWLIRDLDEKLAVLGPGDILWVYMMIAGVLAIAATIPVAAFQTWRFVAPALTDHERRTALFYIPGLFIFFILGIVFGYFVLFPLVLQFLIGLSAGHFQTMFTAEHYFRFMMNLTLPFGFLFEMPLIVMFLTSLGILNPAKLSKMRKISYFALIVVSVVITPPDFISDVLVIVPLLVLYELSISLSAFIYRKKTAAQQGAEAQG

SEQ ID NO: 4448 - protein, 321 aa, Bacillus licheniformis
MSQLRKAPEGILGFPVAPFNREGKLEEEALYENIRFLLDEGLEAVFIACGSGEFQSLSTKEYEQMVEIAVSAADGKVPVYTGVGGNLSTALEWARISEEKGADGYLILPPYLIHGEQEGLYQYTKTIIESTDLNAIIYQRDNAVLTLEQIQRLTDLEQLVGLKDGIGDMALNISLSYTIGDRLGWLNGMPMAEVTMPAYAPIGFTSYSSAISNYIPHISRMFYEALLNGNDRLVKEIYEQVIIPINEIRKLRKGYAVSLIKAGMEIMGLHVKNTARPPIVPVEKEHCRQPRKHSEKRDGALSENDRCPINKKEELEDVCCS

SEQ ID NO: 4449 - protein, 488 aa, Bacillus licheniformis
MSVAAESKTYFNFINGRWVKAESGGMEQSLNPADTRDIVGLVQKSSIEDVDRAVEAAKQAKKAWRKLSGAERGQFLYKAADIMEQRLDEIAECATREMGKTLPEAKGETARGIAILRYYAGEGLRKTGDVIPSTDSSAFMYTDRVPLGVVGVISPWNFPVAIPIWKMAPALIYGNTVVIKPATETAVTCLKVISCFEEAGIPSGVVNAVTGPGSSAGQRLAEHPDVNGITFTGSNQTGKIIGRTAFERGAKYQLEMGGKNPVIVADDADLDIAVEAVISGAFRSTGQKCTATSRVIVLNGVYDRFKEKLLQQTKEITIGDSLKEDVWMGPIANKQQLDNCLSYIAKGKQEGADLIFGGERLADGKYENGYYIRPAIFDNVTSGMTIAQEEIFGPVIALIKADTLEEALETANDVKFGLSASIFTQNIRRMLSFTDEIEAGLIRVNAESAGVELQAPFGGVKQSSSHSREQGEAAKEFFTAVKTVFVKP

SEQ ID NO: 4450 - protein, 458 aa, Bacillus licheniformis
MKKNRAASPDTAGKRSSVRWFVVSMLFLVTSINYADRATLSIVGDSVQHELGLSSVAMGYVFSAFGWAYVVGQIPGGWLLDRFGSKIVIAASIFFWSLFTLLQGALGFFAAGTAVILLFALRFLVGLSEAPSFPGNGRVVASWFPSSERGTASAIFNSAQYFALVIFSPLMGWLAHSFSWHTVFVIMGALGIAMSFIWLKTIYEPKKHPRINAAELAYIEEGGALVSMDEGKNAEKKEKESQWPYIKQLLRSRMLLGVYIAQYCITTLTYFFLTWFPVYLVQARGMSILEAGFVASLPAICGFLGGLLGGFVSDFLLKKGCSITVARKTPIILGMLMSCSMIICNYADSSWLVVSIMSLAFFGKGFGALGWAVVSDTSPKECAGLSGGIFNTFGNIASITTPIIIGYIVNATGSFNGALVFVGANAIAAVLSYLFLVGPIKRIELQKEKDPADTTLSM

SEQ ID NO: 4451 - protein, 455 aa, Bacillus licheniformis
MNTNIHQHVKEEKASQTPSIADMRVIPVAGRDSMLLNLSGAHGPFFTRNIVILKDSSGALGVGEVPGGERIRQTLEQAKPLVIDQPLGAVQSILQSVRRRFKDRDAGGRGVQTFDQRTTIHAVTALEAALLDLLGKFLGVPVAALLGEGQQRDKVKMLGYLFYIGDRKRTTLPYISEQEANDDWFHLRREEALTPEAIVRLAEAARERYGFHDFKLKGGVLSGEEEIEAASALAKRFPKARITLDPNGAWSLEEAIALCKGKRDVLAYAEDPCGAEAGYSGREIMAEFRRATGIPTATNMIATDWRQMGHAIQLHAVDIPLADPHFWTMQGSVRVAQMCHEWGLIWGSHSNNHFDVSLAMFTHVAAAAPGDITAIDTHWIWQDGQRLTKQPFSIADGYVQVPDQPGLGIEIDMERVEKANELYEKMTAGERNDAAAMQFLIENWRFDPKRPCLVR

SEQ ID NO: 4452 - protein, 237 aa, Bacillus licheniformis
MEEDMETLQVESVNRKTLAKQVVERIVHLLSSGQLKPGDKLPTEIELMEKLNVSRPVLREALISLETLGIIKRKTRDGTYFNDKIGIQPFSVMLALAVDNLPAIIEARMALELGLVTIAAEKINDSQLERLQETIDIIANSTDNHYGEADKEFHRIIALSANNPVLEGMIQSLLITHAKIDSQIPYRERDRTVEYHTNILKALQQRDPYQAYHHMYEHLKFVRDKILNGLRDEKNNH

SEQ ID NO: 4453 - protein, 508 aa, Bacillus licheniformis
MLVNQTETPLYIKVNEKDNAAIIANAGGLPQGTVFPCGLKLQERIPQGHKVALTDITQGGAVIRYGEIIGYAVKPIEKGGWISESHIMLPEAPPLDELPIANKVPKPAPLLEGYTFEGYRNEDGSVGTRNVLGIMTSVQCVAGVLDYAVKRIKEELLPKYPNVDGVAALNHQYGCGVAINAPEAKIPIRTIQNIARHPNFGGEAMVIGLGCEKLLPTKIEPEGDAENILSLQERQGFQQMIQSIMEMAEERLKRLNERKRMTCPASDLVIGLQCGGSDAFSGVTANPASGYAADLLVRAGATVLFSEVTEVRDAVHLLTPRAVNEEVGRALIREMAWYDRYLERGESDRSANPSPGNKKGGLANVVEKSLGSIAKSGSSPISAVLAPGERAVQKGLIFAATPASDFVCGTLQLASGMHLQVFTTGRGTPYGLEMAPVLKVATRQSLSEDWHDLIDVNAGRIATGEASIEEVGWEIFRTILDVASGRKTWAEHWGLSNDLCLFNPAPVT

SEQ ID NO: 4454 - protein, 201 aa, Bacillus licheniformis
MAFDGEEGVRLFQQGNYDAILLDIMLPKLNGMDFLKMIREQSKVPVLMISAKDGDVDKALGLGFGADDYIAKPFSMIELTARIKAAIRRATQYSVSEPANQKILRVHELTVDIENVSVQKNGEPLQLTSTEWKMLTLFVTNPKKVFTKEQIYRSVWNDDYFGDQNIINVHMRRLREKIEDDPSSPQYIKTLWGIGYKLAEF

SEQ ID NO: 4455 - protein, 311 aa, Bacillus licheniformis
MTMLWIGILIILASLNIVQYKMKRQRDRNLKYITEKLSVMLNEHEADQILLGTADKVLRALLVQINLFVEEHQHITARFAKTEQSMKRMLTNMSHDLKTPLTVVLGYIEAIQNDSDMAEEERERLLEKLYQKTGEIIQLMNSFFDLAKLESEDKQILLTKIHINEICRKNILQHYDAVQAKGFKAVIDIPDTPVYAHGNEEALDRILQNLLSNAIQYGADGKLIGLSLTYDETWIVITVWDRGKGISEYDQQRVFERLYTLEESRNKAFQGSGLGLTITKRLIEKMGGNISLQSKPHERTVFSITLKRMTY

SEQ ID NO: 4456 - protein, 307 aa, Bacillus licheniformis
MTYIVQTSGLTKTFKGQEVVSNVSMHIRKGEIYGFLGPNGAGKTTIMKMLTSLVKPTSGEINILGHKLTNRSYEILGKIGSMIEYPIFYENLTAKENLNLHCEYMGYHNKAKIQEVLDMVNLKNIDSKPVKTFSLGMKQRLGIARAILTKPYLLILDEPINGLDPIGIKEIRNLFQVLSKEYGMTLLISSHILNEVEQIADTIGVIRDGRLVEEVSMESVRGRNTEYIELVTPNQLHACFVLEHELQIANFKILNDKTIRIYDAEASQTAISKALILNDVEIESMNKKHTSLEDYFLSLINGNAVNA

SEQ ID NO: 4457 - protein, 227 aa, Bacillus licheniformis
MLNLMRIEMKKLKLGWYIRGAVFANFIIFGFLWMVTCTEGKETFQTIDETFLLIGTFVRAVFIVFGAVLISKLVISEFKNKTILVMFTYPINRKKLLAAKLLIAGGLTFVTILISNACVAVGFFLLNSIYGIIPGELTASIASQQALKMIVFAFGAAGTSLVPIFFGMRKYSTAATIISSVVIIMPISSTGPGFSISSIVYIPLSLAAVGLFFSFLAVRRIEKIDVF

SEQ ID NO: 4458 - protein, 184 aa, Bacillus licheniformis
MADAASMLLVIGIFVRSVFIVFAGVLIAKLVIGEYKNRTITVMFTYPVSRKKLMAAKLLLTGGLTFLTMIVSELILAFIFSQLNDVYQFSPEKLTMHDVGNEIGSMLIYAASSTGLSFIPLYFGMRKQSVPATIVTSCILTTLIGQQSDEFPLASIIYIPISLALVGIAIAFWSIRKIDQEDVL

SEQ ID NO: 4459 - protein, 359 aa, Bacillus licheniformis
MEFEIRYISFYVIQVDGKDEQANKQYKHFQTLDTEEFENSELKDFLDGELKKIVKRKAERHPKSEQVPTKIGRFITEPGHELDSNPNYNLFHKTKLAETKEEFNELSEQFVRTYLDTSAVRGGVFLVATAVPRKYFDDTFVFVMKCDFEPKVATIADESSLIRKVEMAITTKNMKSIQYPHMPEEGMTEESEVKIHQASHARYFEDFLKFVEYGESMPEIMKSQVMNMVQEHVYEAFEDKSEELQQFEHDLEIWEASEKREIQERLDTHQVIEASAQIVEHMPEAELKMKLGETEIKGLLAEFGDSIHLAKVNGRYVALIEAETISFEKGSSPVEFYKPEGLHEVIERIRNKIDREDEK

SEQ ID NO: 4460 - protein, 394 aa, Bacillus licheniformis
MRLNSQYIRTQLMVQNILKRNAADTTLKNVSSDITAVAKKASSQAGRASKESLSKLNYSKDSIVNHAGAFRRAYEAANDRTVTDTGKETKINAQNPYVSESDIRKKILDEKYSKINAMNKTKPDPLGYIKDKYKNPNSPYFRNDLSAAERQAAYDNETEWLFKGKAQSYNMQDAAFRNVTFNGEVETENEKVYQRSQVNKQLQALLDQYHIAIPADAALTFTITPIDYQVKVSGTDDEQLIHQIEQILQSGENSKQLFLHIMKSLSSDSAQYSKEAHQKYQTVREIYEVTGYHLKDLEVVDGRYVTPSGRDLLEVYKEELEKDPVLKKTAHLAIAHYGAELNRLAEAEYDSVPDFILSIDYSNGSLRDTGQKKSYGTGDTAWLRELKRRTGVND

SEQ ID NO: 4461 - protein, 303 aa, Bacillus licheniformis
MTTVNEQIEHTLKLAEKHGLRLKRKHAEINESGMDFQVVFAEDEAGKSWVLRKPRRDDVIERAVYEGKVLKLLQNRLPAAVPDWRIHTPELIAYPELPGVPAAVIDMDIKNYVWNMEHEPPAEAFTRSLAKTLALLHGIDHKDAEEAGMHVMNPDDVRQTKAEHMERIKSELGVSAELWERWQKWLSDDSYWPEHTVFIHGDLHPPHILIDQHQSITGLLDWTEAKIADPAKDFLLYQTILGEAETARLISYYEEEGGRVWPRMKEHIKEMQAAYGIEIGMFALQTKQEEHLKMALDALGVTQ

SEQ ID NO: 4462 - protein, 139 aa, Bacillus licheniformis
MNHHRIEANLLDHAFTKYLRSSKKLDEETIPKSITSGKGFILRIIYRHGTCTIKEILQEVALSPSATTTALNHLEKEGLVIRSRNNDDRRTVWIELSQEGTRIAAQMVENRQALIDKLFGKLSEEEKKAFFAVIEKVMM

SEQ ID NO: 4463 - protein, 503 aa, Bacillus licheniformis
MSTLQQLINHHMETSDGLEALSGGDRTFTFKAYHQRVNQLAHYLLEEGVQKGDHIAVLCKNNHHFPVILLASLKIGATVVPLSWQLTSYELKGILNNCRPKVMFYDLEFADILTPLREQLQFCLMIEAGAGMNTTEQFESLFKNRPLKVEAEQVTEHDLALMLFTSGTTGNPKGCMVNHGSLAAYLTEVNVKSKQLKGTRFLASHPLYHMSSLNHVFQAAFEGIALYFLWDPEPFEILQEIEKKRIHMMMAFPSVYTYMLEEMKRHPFDLSSVKMLVSGGTKVPARLIKEYNDHGIMMVQGYGSTEAWTVSVWRPDMGWDKVTSAGKPIPQVSIKIEDPDTHEELPTGEVGEVVVKSPYVFEGYYQNPSATQKVLKDGWFYMGDSGKLDEDGFLYITGRYKDVIVYGGDNIYPDQVEEIIDQVPGVVESAVIGVPDEMYGEVPRAYVVKNESAGLKKEDIIAYCKERLSDYKIPEIVFIDSLPKNRLGKIVKKDLRELAVKGQ

SEQ ID NO: 4464 - protein, 404 aa, Bacillus licheniformis
MKSKWSAMVVIAGLLLLAGCGALKEADPPRGRSAQKTEASFSEAEQRFALALFQDMIKEEGSRKNIFLSPYSIQQALLMTANGAAGDSRKELLSTLHLSQADMASINGISKSVNRSLETLPHGEFSSANSIWTKRELKESFQDAIKGLGDAYQLQIDPNRATEEINSWVKKKTKDRIDQIVDKVSSNTIAYIINAVYFKESWKHPFDPHMTAEQPFYSADGSAKKHPMMTQTNRFPYLENEHFQAVKLPFQDEGLSLAVFLPKKAANLEQLLTGMTHDQWRALQKGWTMKQVELKLPRFSFQTDYMLNEPLKRLGMKNVFSSANFSNMFTGHGAAQINKVRHKTFIKVDEAGTEASAATAVEIIESAPVPEVTMTADHPFYFAIVDEASGMILFLGSVAEPKDD

SEQ ID NO: 4465 - protein, 275 aa, Bacillus licheniformis
MKKSLFLFVFSLFLMAIPAFSASANVYEDEYEPNNSFAEAYDVGLWKYKTISATIHSESDKDYYKFYATKGEQLAIHLKNIPANTDYDLYLFKDAYGYPAVGSSERMGNQNEIIRLDVPETGRYIAVVMSKDGSYDGWGFYRLEFIDRMKSGAYTANLSPSSISSPGQGVVSPVAAVNLANASAIPEGATVKSVSAEGTIYPSLGHTYREVLNKEEGVWHTSVSGGTLFPDLKPELALPVKTTWNVRYYSLAWSSSTWRSPQLKINYQYDSTYGW

SEQ ID NO: 4466 - protein, 275 aa, Bacillus licheniformis
MNIRDRVKLSLYSEQLMKPAAANVPAKTKGSKRMPASQTDTLSISKQAESAQKNAPSLRSQMNGVQFEIYNLYVDRQRLNSQIEGALRESGISLSESEHLTLHVDGHNRITVEGIEDEQKRTRIEAVLNDSDKRFGARLLGHAELIGEQNGTPLDKQAYEKWHVNEFLKTVAGLSLADVSLDERGELEGGNEKLTRVIESAKDPKSDLEKSFQNILKKLKNVLAKGPDTILDRSASFGYAGGTLIDLNVSKGFSAGQLNEWLDDPFLREVLLNNF

SEQ ID NO: 4467 - protein, 250 aa, Bacillus licheniformis
MKMKVKEVADLVGISVRTLHHYDEIGLLAPSETTEAGYRLYSDDDLEKLQQILFFRELDFPLKKIKSILENPSFDKNEALQLHRKALLEKRSRLDQMIATIDKTIQFAKGEINMTNEEKFAGFDFSQNPYEEEARERWGDEAVDRSKAYIESMSEGERKKMEQQYDAIYRKIAALREGAPDSEEAQAAIKEWYDFLNNNTGHSYSLEAFKGLGQMYVADKRFTKNIDQYGAGLAKFMCDAMTVFADRNQE

SEQ ID NO: 4468 - protein, 59 aa, Bacillus licheniformis
MNTYLTGILFVLSGILLLNLAVLSGINGVLWGLVLGGSIIFNLIGVVLLMRYINEKSHT

SEQ ID NO: 4469 - protein, 114 aa, Bacillus licheniformis
MKKTAENYLPLTQATYYILLSLTQPLHGYGIMQRVESMSEGEVKLGPGTLYGALSKLEKQGLIKKEGETGDNRRKQYILTNEGWAVVELEFKRLSKLVAISQSIFQKEGDTSNE

SEQ ID NO: 4470 - protein, 171 aa, Bacillus licheniformis
MSKKRKRKFRFFLAWQDRKEEDWLNEMAKQGWMLKSFFLFIYTFEKTKPSNTVYRLDYKTTSNLDQEEYIHIYEDAGWKHVTQFLNWHYFAADPSQVQTNVIYTDRESEAEKYNGLLKVLYAALASVFLSSGLPILIIGIPGYFYWIAAFNLFVLCLLIVCILKVRRKTRI

SEQ ID NO: 4471 - protein, 53 aa, Bacillus licheniformis
MVIATDDLETTCPNCNGSGREEPEPCPKCSGKGVILTAQGSTLLHFIKKHLNE

SEQ ID NO: 4472 - protein, 314 aa, Bacillus licheniformis
MSRAEKSTAEQSGHIQHGVRKAAGVVFMVFGTMCFASKSIFVKWAYEQGAQPEAVLLYRQLFAAPLFWLIFIVYRSKLPAKPEKAEIFKACAAGLLCFFLSPLLDFIGLHGVSATVERMIVMSYPMFVLIITAFVNKKMVSGKTFAAILLVNAGLFLAVGGWDVQALEANLSGAFLILLSAVAYAAYLVVAGGLVRQIGGIRMNAYGMSAASLAMAGYALLRSLREQPGIVLSYPPAMYGFFMIIAAVTTVIPFLFMLEGMKRIGAERGAVISMIGPVLTIFGGVLFLNERLTPVQWLGCLLVHLTVSLLEYRK

SEQ ID NO: 4473 - protein, 130 aa, Bacillus licheniformis
MQYARFWVRAGAWLIDCVLAVGLHFSSAWIFGDGSHEVAAAALLVYVLYPLLMPLTKLQGTIGKAIFRIRIVSDDTGRRIKLWQAFVRYIVSWVHIFFGLLYLTVVFSGTKQAVHDFAARTYVMKTSDTE

SEQ ID NO: 4474 - protein, 355 aa, Bacillus licheniformis
MGKVKRNMPCPCGSGLKYKKCCGKAEGAFPAVAVQELKQIQKDVMEFAFTEHKDTIDQFLNQYSFLSDLDQSAQKICVFNLGVWGVFARPLADGGLTIFEDFLQKKGSSILRSQTKEAVQSWKDLSPALLRVKHITDGGIRFEDAVTNEELTVRMNVKREGPFVGEYVLGFPIKIGSHTEFFLQFTIYPAKMADALKDRLSEALNRFTEEGGTKEQLMREDFHHVLMHLCRQEESTPSEQVSEDIEWANEMEKETALVFEKGMLDEGHSEPFVSWAVGLWKSYCAKKAPVIKKTEAFAAALEYFINTISKSEKSISQAKLAKKYGVSASTVSNRFKDIEAVLQDELDHHLELMPS

SEQ ID NO: 4475 - protein, 238 aa, Bacillus licheniformis
MSTILLETRHLQKKFGRSQAVSDVSLSVEKNSIYGLLGPNGAGKSTTLKLLTGILNPTAGDILFEGRQWKRSVLKDIGSLIESPPLYDNLTAYENAKVHAALLGLPDARITEVLKTVDMHHTGKKKAGQFSMGMRQRLGIAIALLNRPKLLILDEPTNGLDPIGIQELRELIRSFPEQGMTVILSSHILSEVEQIADHIGIISGGYLGYQGKINKGDDLERLFMDVVKSTREKEGGEK

SEQ ID NO: 4476 - protein, 252 aa, Bacillus licheniformis
MIGYYVKAENLKFKRTFSRKMIFIVPLINICFAFLMNPGFFVAGTYNWWSVILMPVMIALLCAQSHQKEKKASNYNGIFSSPVDLHQIWYAKISVIALYSLASQAVFLGFMVGMQFVIPQFSSIHLTVIAANLLLWLTTLWEIPVCLWIARKYGFISAVLFNMLGTIILGIMSASSPFWWLNPWSWPIRVMCPTIGIHPNGVPLENGDPLTSWAVVPPAVVLSVLLFAILARLTRRSFSPAVDRKSIKREAV

SEQ ID NO: 4477 - protein, 256 aa, Bacillus licheniformis
MLLFFRCLAADFQKTKRTSFIWLHLSVPVICAGVFLLYFYNRQPDPYQLYRTYFEAIAIALPLLIGIVCGMTASLEEQAGRFQVLLGGTAPKLTAYLSKVTLLLIMNIFAVFLAIGLYLLGLRALFHVPNLPSSLFLEAGAWLAAGSVTLYFIYFLISCTFGMGASILAGGAGLLMTALMNTGLGDVIWKYNPWAWGIRLTGYKGIDRFVQIDPSLRSVLDGEIKQGAFIMVFAIIAVFALSIIWFIRWEGRKAFE

SEQ ID NO: 4478 - protein, 220 aa, Bacillus licheniformis
MAKILAVDDEKDILVLIQNILRRDQHQVHTLSQVNTESLDVFSGYDLILLDVMMPGMDGFELCEKIRPLVDCPILFLTAKTEEEAIVKGLLTGGDDYISKPFGVLELSARVNAHLRRERREKYETKRVISGFLFHFDSKEVFIHDQKLNLTKNEFKICELLAQHKGRTFTREEIYDHVYGLEGNALYSTITEFIRTIRKKCKEHNRDPIKTVWGVGYRWE

SEQ ID NO: 4479 - protein, 456 aa, Bacillus licheniformis
MGIIRKKKTLRRELIKYMLTLSFSLIAITALYVLVNMIGMNAGLFYPANYNEIEAEKLKPRLQSAEQITEDMIPDTMLYAILDKKSKQKTAGNMKETNLSIVRKKIESRPYVSFSQKGYMIIERKDEYCVLEYPLRAEFRSPLLRRFLPNYELTSICIIVLLLITVVFTVTTRFANRLKEHFQTLNTIAEQIKKQNLNFTPEFSNIKEFDHVISSLMDMRNALQASLRAQWHLEKTKKEQIGALAHDIKIPVTIIKGNAELLSLSPQNQEQSEYIRYILDAGQKIEQYIDQLIHLSKTEEALHTEYREGAVKTLVESVLHETEAYIGNKSIDIVLKEQNLEGKKAVFDKQLLHRALMNIMTNAADHTPEGGRIDFEAVCTADQLIFTITDSGKGFSQDGLQKAAELFYMEDKARTSNGHYGMGLTFALRVVKLHQGDLAIKNSEAGGGQVQVTIPL

SEQ ID NO: 4480 - protein, 294 aa, Bacillus licheniformis
MDFKTLKTFHKIVACGSFNRAAEELNYAQSTVTMQIKKLEEDLGIRLLERGKTFRLTEAGRLFFEESRHIVKDIDHLQHHMADLLLGEGGNIRLGAVEPIASCELPQILGRFLADYPKIRVSVDIANSSALGERLVQGSLDLAVCSTPAMGTDLYFEPLYAEELVVLLPEGHPAGNNERIHLKDIREHRLLITANNCTYRKKVEIAFQELPGSQMNTMEIGSMTALKNYVAAGLGVALIPKSIVSPPPPGTIVRFIDDDPISVTFGILCKTAAFPLKQADAKLYQYLKQELGEP

SEQ ID NO: 4481 - protein, 131 aa, Bacillus licheniformis
MPFVRMDLLKGRSKEELRRISRSVHQAMTEAIDVPEDDYFQVITQHDEEEFFFDPSYMNIKRTKDLIYIHITMKERPIEKKLALYQRIAERLQKNAGIRQEDVMIIAAENVKENWSFGNGTAQLASVERER

SEQ ID NO: 4482 - protein, 246 aa, Bacillus licheniformis
MEMKNKTALVTGGGTGIGRAVSLSLANRGAAVVVNYSRSKAEAEETVGMIESQGGRALAVKADVSKISEVQDMFDRAVGEFGTVDLLVNNASITRHIELDDLEGASEEVWDELYAVNVKGMFNCARAAAPFMKRNKQGAIVNVGSIAGLTGSGSSLPYAVSKAAVHGLTKSLAHALAPDIRVSCVAPGAVSTRWWEGNEEKMKRLSQKLPLERIAEPEDIALLICALLEQETVTGQILTADCGQTL

SEQ ID NO: 4483 - protein, 694 aa, Bacillus licheniformis
MRRLQSLEAIEKVKNGDYHVLRDAEWLKYLVLTEEQNINLERISSLENMPQNPVFLYVEQTLSILEKADIPELEKEIIEEVLIWSEAAKCGQPHKRKEWREKGFQLAIHNIGSAQIYADRRQAYMPERQDIEELIHILIVTHGLVGQYIRGETRYRQFTPLIDWIETSELQHIDIRRVLYVLNKCIIEAVSPALWDSIERDVNRVIGQICTGERNKDWPFAERIRKLRGQALDSGEDSSRYERFLREHSAEDTLRRFFQRIDLWYVESALSSFSFEEFVKIFLLVLRSVNPLSVKHISFEPLMKDMYRDYQGVRHINVYKKRIIEACLKEMSISDLLYGEVPVNEHVSLAVQPFDQASEIVGVTFSFSQAGLKLIEFCQEAEKSPLYERAIVLLYDFFEFRKDSFDRLQNEAAYLSDMNGAEDYKKKIADYAVGERMLDIGAGGGVMLDLLTDQHPEAEVIGIDLSVNVIEELQKRKVREHKPWHVKQADALDLPEYFEQESVDTIVFSSILHELFSYIPYEGKKFNHLVIAQALKSSFDILKPGGRIIIRDGIMTENKEETRRIRFKDPDGMDFLKRYVHDFKGRKVQMLEAEKDAAVLFVNDAMEFLYTYTWGEEAYPHEVQEQFGYFTPSEFRRCIEKELGERANILVFEHYVQEGYEEHLYPKIELTDRLGRRVPLPDSTCFIVIEKKHL

SEQ ID NO: 4484 - protein, 358 aa, Bacillus licheniformis
MRSKKFFLMMLLMIVAVVSTACGGSKSASGEKEDTKKADNAEVKILSSEYTLPDDSSTNLHENELILKINVSVKNTGKEPLMVDKSQFSLYEGDSKMSDVSVYDERNKRLRSSTLNSDKEVDGNIYYIVEKGKKFQLEYTPDMYGENKADPVKFEIDGGSDELLKTAKKLEDPAKALLAYTDVTIFGKDNNNFDKLVDENKREVVTDYLEGAQKSIVRSLGYYDEEDVDKKKLNKLISAIQNAYQEKSQVKAVTKSISGDEATVEATVTPIDNTDVQKKVKKRLEDYVKDSGKDFMSRDELINPAIDIMSEEIKKAEATSSEKTVEVKLEKSKNDKWKIDADNYKTEQYFSSFLKSNN

SEQ ID NO: 4485 - protein, 466 aa, Bacillus licheniformis
MSNGTPQKTKLHFPHTYALIFFIIILAALASYFIPSGEFKRVEEDGQTVIVQGSYKQTDAGPVGFFEMFKAIPEGMIQSADIIFYIFLIGGAFGIIHQTGMIRAGVHVLVQRLKKRGFLLIPVTMFVFSIGGATIGLSEETIIFIPIGIAVARALGYDSMTGLAMISLGAAAGFTGGMLNPFTVGIAQTIAEVPVFSAFGYRLAVYAAMLGFSIFYVMRYAQQVKAHPNTGLMYGSETEINEETAAGHADLSFTGRHGLVLLITALGFGINMFGVFQWGWFLSELSAGFLIIGFAAGLAGGRGINNTFHSFVDGMKQVVYGALIVGFARAIVIVLENGHIIDTIINSLASAISSLPNEISAIGMFAVQIAINTFIPSGSGQAATTMPLMAPLADLLGFERQIAVFAYQYGDGITNSIIPTSGVLLASLSIAGVPYERWVKFVWKLIAGWIIIGAAAIVIAMIIGIK

SEQ ID NO: 4486 - protein, 391 aa, Bacillus licheniformis
MKKQIEKEIENIREELLHISQYIGNHPELGHEEFKASKILSEELKKHGFQVELGTCGLATAFTAEFDSGRPGPSIGFMAEYDALPDLGHACGHNLIGTMAVGAAIGVSKVIASCGGKVYVYGTPAEETKGGKVTMAEQGVFDHLDAAMMVHPYCRHEKSGTSLAMDAIQFEFFGKASHAAGAPHEGINALDAVIQTFNGINALRQHILPDARIHGIIPEGGKAANVVPDYAVAQFYVRGTERAYVNELLDKVKNCAKAAALATGARLESSFYELSYDDLKTNETLSDAFTQNMIELGVDPDSIHEKADGGGSVDMGNVSQIAPSIHPYVQICDEPYACHTPEFREAAMSSRGFEGLMLGAKSMAFTAYDVLINEELLKKIKEEFNLLKALA

SEQ ID NO: 4487 - protein, 150 aa, Bacillus licheniformis
MNIRRLHPEHEPPLDLLLTADPSEKLVNDYLERGQCYTAEIDRRIAGVYVLLPTRPETAELVNIAVKEDLQGKGIGRQLVMHAIETAKAQGFKTIEIGTGNSSIGQLALYQKCGFRITGIDRNFFLRHYEKPIYENGMRCIDMIRLSLDL

SEQ ID NO: 4488 - protein, 499 aa, Bacillus licheniformis
MNISDYVKHDAVALSKLIKHGEVTVNELIDAAFSRLEEVNPELNAVIRTRKEQVKIESKQLDIRHQPFAGVPILLKDISQALKGEPLTAGAKLLSSYKPKRDSNFVAKLRGAGFLFLGQTNTPEYGLKNISEPELYGPSRNPWNTDYSPGGSSGGSAAAVAAGIVPLAGASDGGGSIRIPASFTGLFGLKPTRGRTPVGPGAGRQWQGASIDFVLSRTVRDSAALLDILQTIQPEAAFQTPLFPGQYEEDMKKGLERPLKIALSVESPVGTPVSDEAKQAVRRTVRWLEAQGHHVEEQTNGVDGIRLMENYYLMNSGEISAMILGMEKTLGRAITVQDVEIVTWVLNEAGKKVSAAEFTASLASWDRAAAQMAAFHETYDLYVTPATAYPAPKVGELTHTEKEAEALLKVSELEKIEQQSLIYQMFLKSLTYTPFTQLANLTGQPAMSVPVHLTNEGLPLGVQVTAPKGKEHWLLRTAHLLEQSDLWIGMKGNPMLGSL

SEQ ID NO: 4489 - protein, 611 aa, Bacillus licheniformis
MEKVAEKRPKRCEVPEELTWNLTDLFSSYETWEDALVKIEEDLASIGSFKGRLHEGAGVLLDCLSLREILLKRLVRAAAYTHLRKSEDLTNPVNQADASRMAALQAKINAGLSFIQSEILEFPENQVETYIKNEKGLEPFSKMLTEIMELKPYKLAPETEEALAVLGEIHDAPYKIFGMAKLADMQFSPIQDRNGNTLANSFALYEGKYMFSPDTHIRRTAFDSFTNTLQTYKNTIAAIYETEVKKQVSMSRLRGYESVTHMLLQPQSVTLEMYRNQLDVIKNELAPHMRKYAALKKRVLDLDEMRFCDLQAPLDHDFSPKTTYEQAGRMILDALQVMGPEYTEVMETALTERWVDLADNIGKSTGAFCSSPYGAHPFILMTWTDTMRDAFTLAHELGHAGHFYFANREQRIMNVRPSLYFIEAPSTMNEMLLAQHLFSKTNDPKMKRWVINQLMGTYYHNFVTHLLEGEYQRRVYELAEQGHALTASVLSEQTSAVLSEFWGSGVKVDEGASLTWMRQPHYYMGLYPYTYSAGLTASTIVSQQIKEEGRPAVDRWLNVLKAGGTMKPLDLLKHAGVDMSTDQPIRRAVTYVGTLVDELEKLYDKKEDRPD

SEQ ID NO: 4490 - protein, 89 aa, Bacillus licheniformis
MFGFIWSLIIGGILGWLAGLIIRRDVPGGIIGNIIAGFIGSWLGSMILGRWGPVVGGFNIIPALIGAIILIFIVSLVMRSMGGRNRNAQ

SEQ ID NO: 4491 - protein, 571 aa, Bacillus licheniformis
MKQSLKALKGFRAFAEEKMKEWNVPGAAVAVIKEDEIIMAEGFGFRDKERKLKVNPETVFAIGSASKAFTTAAMAVLADEGKMEWDKPVREYLPEFKMHDPVATERMTPRDLACHRSGLPRHEMMWYNSSFSREELFRRIRYLEPNQDFRSKWQYQNLMYMTAGYLAGRIAGTTWEDLVHERLFKPLHMTSSSFSVEDMQKLSDFAFPYQENNGTVEKIPFRNIDAIGPAGSINSNAVDMANWLLLQLGSEKFNGVLSDGSLHELHTPCISCDSIIKAKELPVCSYGLGWFVEPYRGRHMIHHGGNIDGFSSLVAFMPYEKIGIVILTNMNGSFLPNVLAYNIFDRLLGLEEIDWSGRLKGEAEKIMKAALGVDRTADLTKIEGTNPSHALKDYTGVYEHPGYGEIKIELKDGVLQALFNSFVMPLKHYHYNIFEMKMPLTEMAMLASFDTDIHGHISRLSIPFEMAEGAREIEFVRKPDQQLYDPEFLASLTGKYALGDGTDVVVSLRNNRTLWVSLPGQPDYELEPYRELTFQIKNLPGFSVRFEAGDSGQVTGLRFIQPNGEFPAVRK

SEQ ID NO: 4492 - protein, 440 aa, Bacillus licheniformis
MTTADERKVIEQQFKQRMDEEELLNCMRCGFCLPSCPTYIESGFQESHSPRGRIALMKAVVDGTIEPDEDVERSLELCLGCRACEPVCPSGVNYGRLLEEARDIIQQNKKHAFPVKVLRRAVFKGLFPHPNRIRALTGMLGLYQRSGMQNVIRKSGLLRLLPDHLAKMEAVLPKVPNMKQLKKRPHLLPAIGERKKRAAFFSGCLMDTLFLDTNMATIELLRLAGCEIIIPEQQTCCGALHGHSSEKSEAILLAKRNIQAFEDSNADFIITNAGGCGAFLKEYDHLLKDDSEWRERAASFTGKLKDFSSVLLELNFDQQSLELPEQIVTYQDSCHLRNVMKTSAEPRRLIRSIKGIEFKEMKNAESCCGSAGIYNIVESEMSMKILDTKMEAAAATRAATIVTANPGCLLQMKLGIERAGLTDRVRAVHLADLLLEAVQK

SEQ ID NO: 4493 - protein, 470 aa, Bacillus licheniformis
MISSQVRSKLIEIVGSANYDDSNAGRLVYSYDATPQFQSMPDAVIAPRSKEEVSRIVKICNTHRIPIVPRGSGTNLCAGTCPTEGGIVLLFKHMNQILEIDEENLTITVQPGVITLDLIHAAEEKGLFYPPDPSSMKISTIGGNINENSGGLRGLKYGVTRDYVMALEIVLANGDIIRTGGKLAKDVAGYDLTRLFVGSEGTLGVITEATLKLIPAPETKKTVLALYQDIDSAAQTVSNIIAHKIIPTTLEFLDQPTIQVIEDFAKIGLPVHAKAVLLIEQDGTEDAVRRDIAVIEEICKKGNAVSVQTAQTEAEAENLREARRTALSALARLKPTTILEDATVPRSEIAEMVKAINSIAEKHQISICTFGHAGDGNLHPTCTTDVRNSEEMKRVEQAFEDIFKKAVELGGTITGEHGVGEMKAPYLELKLGNAGIAAMKAVKQALDPNNIMNPGKIFAKDSRKRVVVTR

SEQ ID NO: 4494 - protein, 100 aa, Bacillus licheniformis
MKIALVCSAGMSTSILVKKMREEAENRSLKAEINAYAEADLPSDLDEIDVILIGPQVRYLKGQMTERAKPYHTPVAVIDQMAYGMMDGAKVLNQAISLAT

SEQ ID NO: 4495 - protein, 110 aa, Bacillus licheniformis
MADTLQLEQVSFEIILHAGNARSSAMEALQLVKHHECETGYQKIQEAESELNQAHQAQTRLLQKEAQGAGLSPNLLLIHAQDHLMTAITVKDLAKEMIDLYQELGKGREK

SEQ ID NO: 4496 - protein, 428 aa, Bacillus licheniformis
MKQNKMMAFIESNIMPIAGRIGSQRHLIAIRDGFIAIMPLIIIGSLAILVNNFPIPAFQNFMTGLFGEGWTAVGGAIWNGSFALLSLLAVAAVSFKLAESYHTDGLSAALIGVGAFAVLTPTTEDFGFSMTWLGAQGLFVGLIVALLSTEVFRLFSKNEKLKIKMPEGVPDGVTKSLNALLPAAVILSTAGLCNALIVHFSGQSIHELVFSTIQEPLQGLSNTVGSALIFTFLNHLLWFFGLHGTNILGPIMESVYLPLIQENQHLFSQGMSAFEVPYIVTKPFFDSYVFMGGSGTTLALLAAILIAVKSKHYKTIGKVSLAPGLFNINEPVLFGLPIVLNPIMFIPFILIPLILTITSYIALASGLVPKTVAILPWTTPPIVSGYLVTGGSVRGVFLQIFNLVLATLLYLPFIKAAQRSALHQTENE

SEQ ID NO: 4497 - protein, 444 aa, Bacillus licheniformis
MALKVVVIGGGSSYTPEIIEGIIKRHHQFPVNEIVLVDIEEGKEKLRIVSELAKRMIRHAGVPIELSHTIDRAKALKGADFVTVQIRVGGLKARALDEKIPLSHGLIGQETNGAGGMFKALRTIPFMLDIARDIHEICPEAWLINFTNPAGIVTEALLKHGPHQKVVGVCNIPYNMKNSIAEIFGVDVNLVMIEFAGINHFVFGKRVWIDGIDRTEETIELLLNDHFGYSPSNIAALPWNRQFLRSLRMLPSPYHQYYYQHEDALAKDIEAYNNKGTRAETVMEVERQLFERYKDAKIHEKPKELESRGGAYYSESACSLMNSLYHHSMDIQTVNTLNKGSIPDLPDDAVIEVNSVITKSGPIPLTVGKLPDAISGPIILMKKFEQLVIEAAVTGDYDTAYLAMITNPLVSSDHKAQKVLDEMLEAHKRYLPQFFEEVRAHETK

SEQ ID NO: 4498 - protein, 242 aa, Bacillus licheniformis
MAKQPQLHSQIKQDIVDKIESGYYPPGSLLPTESEFCKIYDVSRTTLRTALNHLLMEGAIYRKQGKGTFVAKGKVKQILSSSSLRYAEQLKAQGFKPKIKVVDLQKIKPSEKLQTRLGIDAEQMVYQVKRIRYADDEEIQFETAYIRTDLVPEVTEEMANISLYQCISRQGNNIKRTEEQIKIVISDEEIAHHLNITQGTPCFQISTQTFLASEEVVEYSMAYFRGDRVEFFIERDYGQRGK

SEQ ID NO: 4499 - protein, 244 aa, Bacillus licheniformis
MKSLIINADDFGFSRGVNLGIIEAFQHGVLTSTTLMVNMQEADHAVELARQNPELGVGIHLTLTAGRPILGGLHTITDEEGNFRKLLYYQGFFDIDLEEVYREWKAQIEKALSCGLNPTHIDSHHHIHTYGNLPEVFVEVAKEYDLPCRKVNHDHPSLWKGVRSNDAFELKVDRLKDLSSFFNDYQDAAVIEVMCHPAYVDKCLLEKSSFHYPRAYELSLLTEPSLKAALQHCPDIRLTSYAGL

SEQ ID NO: 4500 - protein, 595 aa, Bacillus licheniformis
MLINKSKKFFVFSFIFVMMLSLSFVNGEVAKADSGKNYKIIGYYPSWGAYGRDFQVWDMDVSKVSHINYAFADICWEGRHGNPDPTGPNPQTWSCQDENGVIDAPNGTIVMGDPWIDAQKSNPGDVWDEPIRGNFKQLLKLKKSHPHLKTFISVGGWTWSNRFSDVAADPAARENFAASAVEFLRKYGFDGVDLDWEYPVSGGLPGNSTRPEDKRNYTLLLQEVRKKLDAAEAKDGKEYLLTIASGASPDYVSNTELDKIAQTVDWINIMTYDFNGGWQSISAHNAPLFYDPKAKEAGVPNAETYNIENTVKRYKEAGVKGDKLVLGTPFYGRGWSGCEPGGHGEYQKCGPAKEGTWEKGVFDFSDLERNYVNQNGYKRYWNDQAKVPFLYNAENGNFITYDDEQSFGHKTDFIKANGLSGAMFWDFSGDSNRTLLNKLAADLDFAPDGGNPEPPSSAPVNVRVTGKTATSVSLAWDAPSSGANIAEYVVSFENRSISVKETSAEIGGLKPGTAYSFTVSAKDADGKLHAGPTVEVTTNSDQACSYDEWKETSAYTGGERVAFNGKVYEAKWWTKGDRPDQSGEWGVWRLIGGCE

SEQ ID NO: 4501 - protein, 693 aa, Bacillus licheniformis
MKKAASSFLSCMLLLALFIPNRQISAETSSERPDCRPEGLWDSGVEHVPYCDVYDKDGREKLANQLDRRIIGYFTSWRTGKGNQDRYLVSDIPWKYLSHINYAFAHIGEDHRISVGEEADENNPSIGMTWPEHPDVKMDQTLPYKGHFNLIHQYKDRYPDVKVLAAVGGWAETGGYVDKDGKRIPSGGFYSMTTNGDGSVNHKGIHTFAESVVAFLRKYEIDGIDIDYEYPTSMQDAGNPADWNIANPRRNGLNKSFEALMKTLREKLDQASAEDGKYYMLTIAAPSSAYLLRGMETFKPLRYVDYVNIMSYDLHGAWNEFVGPNASLFDNGEDAELKQSNIYTTPEYEGIGYLNTDWAYHYFRGAVESGRINIGVPYYTRGWKNVTGGANGLWGRAKSADCPQGLRQCGDGATGIDNIWHDKDEQGNEIGAGANPMWHAKNLEKGIAGSYLERYGLSKADLTGVYKRHYDAGLAAPWLWNPEKKVFLSTEDEESIKTKADYVIDKGIGGVMFWDLSGDYDWYPERNGSKGEYGIGNTLTRTMYHKFSDTTPYDNRLSTSPLPDESLDAEVELTNFPLGDQNYPIHPVMKLINNSDVTITGGSFIEFDAPTSTSPRFRSWSGDHVEVISKGHTGPNIGGLTVDFHRIRVTLSIWKTIKPGEEAEFQLVYYLPISGPSNFTISIDGKKYRLKGN

SEQ ID NO: 4502 - protein, 316 aa, Bacillus licheniformis
MVSKKSVKRGLITGLIGISIYSLGMHPAQAAPSPHTPVSSDPSYKAETSVTYDPNIKSDQYGLYSKAFTGTGKVNETKEKAEKKSPAKAPYSIKSVIGSDDRTRVTNTTAYPYRAIVHISSSIGSCTGWMIGPKTVATAGHCIYDTSSGSFAGTATVSPGRNGTSYPYGSVKSTRYFIPSGWRSGNTNYDYGAIELSEPIGNTVGYFGYSYTTSSLVGTTVTISGYPGDKTAGTQWQHSGPIAISETYKLQYAMDTYGGQSGSPVFEQSSSRTNCSGPCSLAVHTNGVYGGSSYNRGTRITKEVFDNLTNWKNSAQ

SEQ ID NO: 4503 - protein, 257 aa, Bacillus licheniformis
MYSDLKGKTAIVTGSSKGIGKAVAERFGKEKMNVVVNYHSDPGGAREAVDNIQAAGGNALAIEADVSSEEDVKKLINSAVEHFGSLDVMVNNSGFNGAGAFPHELELDEWQKVIDVNLTGAFLCAREALKYMADRRMKGSILNISSVHQQIPRPKNVHYSASKGGMKLLTETLALDYADKGIRVNAIAPGTIATESNEDLEGSRKSEQLKKIPMNEFGEPEQVASAAAWLVSQEAAYVTGATLFVDGGMTLYPSQLE

SEQ ID NO: 4504 - protein, 272 aa, Bacillus licheniformis
MQNNIVHIAFGESAGGSINMMLKQSGGTHEKSLIVLPELFSIGPLQKLEAKEGRVNRYEWLKTYLNDRFHESGKRYSRFEVAVSALSGIPEQASVFIWTGDHAHEQTGLRFVHHILRQMNLAVFHLNTTKFFPHTRSSGELNDENLRFIYEQGDQAAVTAAEGRRLAEEWTALSQQTSVLRVWEDGRIKSVKEDFFDSFIIEKLAQLQKNRSANTFINCLSLIGEVIGHLEENIGDEFIEYRILELIRKGIFEMKGTTKGMRYFNVRLKNVM

SEQ ID NO: 4505 - protein, 465 aa, Bacillus licheniformis
MVREQLKQKAQSISKVPPHYQLMIEDYGEKYEKERRVFFAWQDIEEPERDISVELDHQGRLISLTKEYEPVVEEALPDERLLQIALQFTEQHYPNAPYEFVFHEKKVTEQFVRFTYVQTVLDLPLPQTGFYVRVAKNGEVIEFRYNGGTSSFSIPKQIADKQSVTADYLEHVQFELAVEKIRSELYEGGDDLPHLIYEADLPFFSYPADITEKRQMKPAADDEEEEDTLPLPVLPEADRHADIDDMIGFTPSMRKIRETDLGESIGTVWRLGDDPEPRDRSIAGYFETWNQNTLKIVKDKNSGKLKGIASFIKSEGPPVLSGEDCLKRALQFLYRLYPDADRLFRMHPAENDGDRSNAFFQFDLQYKGVPLRLGSANISINRTTGRVVGYHGPEIEPETLIDLSPSPSISEEEAKAVFAAAFDVKLQWERDYSREKDDFYRLVYRPVYPYFIDAHDGKAFMSKNI

SEQ ID NO: 4506 - protein, 283 aa, Bacillus licheniformis
MSVLKSPEWVYKRLMEKTDQTVIVDVRFHLTKPDEGRKAYTKGHVPGAVFIDLKEDLSRNPEEHGGRHPLQDPDLLAAKLGKIGIDRQTDVVVYDDSGGMFAARFWWQLHYLGHDSVYIMDGGLSNWIKAGYEVNAEDPRPSEREFKPALRENELLDAKEVLKRIGREGSILIDARDPSRYTGETEPLDHRAGHIPGAKNFFWKGNLTEGGLWKSKEQLRQHYAALDPGSEIVVYCGSGVSACPNVLGLKEAGFENVKLYAGSWSDWISYPDHPISTGAEDDI

SEQ ID NO: 4507 - protein, 142 aa, Bacillus licheniformis
MAVVQASSKDISLLARLLRAEAEGEGVQGMLMVGNVGINRIRANCSDFVGLRTIPQMIHQPHAFEAVTHGYFYQRARESERRLARRAVNGERLWPAKFSLWYFRPAGACPAQWYNQPHVGRFKSHCFYEPTAEECENVYNTF

SEQ ID NO: 4508 - protein, 330 aa, Bacillus licheniformis
MMQLSILDQVPISKGSDAHSALKHSAELAELADQWGYKRYWFAEHHSTRGLASTAPEIMIAHIAAKTANIRVGSGGVLLPQYSPFKVAENFRQLEALYPGRIDLGIGRSPGGTTKTRLALTDGVHKSLHEFPRQLQDLVSFLTDSVPSGHDYFGIKASPLTDSPPEVWLLGLGENSAKLAGSMGAGYVFGHFISPARGKNAFQSYRESFRPSPFFKRPQSLAAVFVVCAESDEKAEELCLSQDLWLLRVEKGLDSLVPSIEEAKSAAYTAADKKKLAQNRSRMVIGSPQTVKRKLLELSERYQTDEFMILTNVYRFEDKKQSYERLAELF

SEQ ID NO: 4509 - protein, 452 aa, Bacillus licheniformis
MKKKVYTFGLASILGTASLFTPFMNNTASAETSQQKQEIQQKRSEVNSGIESKRKEIAKLQDEQKKLEGKIQELDKKALETSNKIEDKEKENKKTKKEVEALKKEIKETEKRIEERSKVIKNRVRSLQENGGSQNYLNVLLGAQSFGDFITRATAVSTIVDADKDLLDEQEKDKNKLEKAMSDLNTKLDEIQKTLADLKTLKSDLDKQLKEQANLSKQLQTKQAAAESELSDLKKEAGSLTKEEAALEQKLKEERAAAAAAAKAKEESATAEKSDSGSSSSSNSGSVSKSDGSSNSGSSSSKKSSSPSRNYSSGSVVSSNGNAIEAAISTGSSIVGRSPYKWGGGRSQADIDNRRFDCSSFVRWAYASAGVELGFGATTSTLVGKGRAVSASEMKRGDLVFFDTYKTNGHVGIYLGNGTFLNDNSSRGVSVDSMSNPYWKKAFNGVVRRVVE

SEQ ID NO: 4510 - protein, 270 aa, Bacillus licheniformis
MNLSLYKQMLRTNMKGIMSYGVGSAFYILLILGIYPSIAGNAEDIEKMIKSMPEGFLNAFGFENGLGNLEDFISGEYYGLIFIVILSIFSVMLSTKLLAKRVDQGSMAYILSAPTTRGKVAFTQAAVLTTGLLIIMAVTTAAGLAGYHLMLGGDYDFNVSRFLVLNLLGFLLFFAVGGISFLFSAISNDEKRALGLSGGITFLFFSFDLLGKLSEKTEWLRSLSVFSLFRPGDIVNGSTDIAQVSLVLAAVGFAAFALSILIFKKRDLPL

SEQ ID NO: 4511 - protein, 295 aa, Bacillus licheniformis
MLTVERLTKKFSNGKGIFDLSFHVQKGEVFGFLGPNGAGKSTTIRHIMGFMKPDQGDIKVNGMDVLKQQGDIQRHIGYLPGEIAFIEGMTGKQFLDFMADMHGLKDTAKRNDLIERLQFDVHTPIRKMSKGMKQKVGIVAAFMHSPEVIILDEPTSGLDPLMQKVFIEIVLEEKAKGTTFLMSSHSFPEIERTCDRAAIIKDGIIIAVKDIHELQSMQRKVFEVTFENTGDIPAFMNSSLQIESRTDNRVKVAVLGNHDQFIKETAKYHIRHIDASSQSLEEIFMNYYNRKGTAQ

SEQ ID NO: 4512 - protein, 195 aa, Bacillus licheniformis
MNGFEKRALLIKEKIKKTALDMLKTWEPKRIRITDIAKEANVSQVTIYNYFGSKEALLKEVFKDYIDQSISEFEEYMNKDISVKEKIELMILQKRAANNQKFALTVIKEVMIEDSEIMDYVKQQYDEKIIPLMLQMIEEGHRTGEISSKITAESFLIFMNMIIEHSKTLGKAFEKNRKFTEEMLHIFFYGLCGRP

SEQ ID NO: 4513 - protein, 631 aa, Bacillus licheniformis
MKHSFFFFMFIAFFLVTGFSEAGKSFSIERADIRATVKENGDLSVEEVYRYDFKGSFEGATRSFSEETASRLKNFKAYLLPDHRRKGGQAIPLKTKKEDGTYFAYSASKDETKNVMFRYVIEDAAQKFEDTSILIHSFYQKANTDFGRVKIEVRLPDSVKARDIHAFLREKGNGKITKVNDSSVTYETGLYRAGTGSELRIYFPQSALKEAVRHPSYQTKDELLKEERDEAKRYAERDERIAGAERMILIFSGIVGFMVIMAVMLSFLKKRRRAMLSFEELESFDPVLVAFLYKKGRFTDRDLLAGLLSLYQRGLVTMQKVQAEERFLDDPKAPDDTYEFEFSGSKADLPKPDQLLIEKLFEQTGSDTYMFRLDSLSGPTEEECKHKEQLGKYERKRIILQNVVQKWTESVRQAPEFRELFQENRWLRMLSLSLLSVHTGLLLFILYADVVHQAGFMAACVIFGFALSAGIVLAKSKLYTILFLAGLFLASVFTDSVHTILYYGICVGLSILLIAFIPAVKESRYASICRRSILSWRNHLRKEDLFSGRSLSQNEKTMIFAIVLEVEDESAVWLNQSANRLDYASPVLGMAAAGCLHYPFYSWQLPDSQQHAGAYDAGGSGAGGGDGAGAF

SEQ ID NO: 4514 - protein, 160 aa, Bacillus licheniformis
MGKTIINKPFTAAPEDEVVVFVIGMRVNKWHAVHKWWPVFTAMPPMIKELYQNKNLGFLAMESFINFRTICLIQYWRSFEDLTAYAKGDKHMAAWRRFYQKTAASGAVGIYHETYSVPKGRYEAFYHNMPVFGLAKAYGHQPVTRGTKTAEQRMRGTEII

SEQ ID NO: 4515 - protein, 187 aa, Bacillus licheniformis
MTKRNHTTYALLGLITAGYRTGYEMKRMIDQSLNHFWKISYGQIYPALRQLTEAGWAAASPALSDKKQDRKEYMITAEGQKALQSWLEEPINDIASEKNEFLLKLFFSKEESREKTALKVKEYQQKLEERLEAYKAIEQSILSCSSHSKDREYWLFTLDYGKRTTSAGIEWCEATINRLNGKEGTNG

SEQ ID NO: 4516 - protein, 200 aa, Bacillus licheniformis
MAISLEKGQRIDLTKGKAGLSKILVGLGWDPVASGSGGFFGKLFGGGTPNIDCDASVLMLENGRVTENKNVIYFGNLRSRCGSIEHTGDNLTGEGSGDDEQIIVDLQKVPSHIHKLVFVVNIYDCVKRSQHFGMIENAFIRIVNMNDRSEMVKYNLRDDYSGRTSLIAGEIYRDGAEWKFTAVGEGTNDTSITEIVKRYA

SEQ ID NO: 4517 - protein, 193 aa, Bacillus licheniformis
MAISLAKGQKIDLTKTNPGLSKVVVGLGWDVNQYDGGADFDLDASVFLLNAEGKCSSEKDFIFYNQTEGAGGAVIHTGDNRTGEGEGDDEQVKINLNAVPADIQKISFVITIHEAEARRQNFGQVSNAYVRVINEDSNEELIRYDLGEDFSIETALITGELYRHGGEWKFSAIGSGYQGGLARIATDFGLQVG

SEQ ID NO: 4518 - protein, 192 aa, Bacillus licheniformis
MAIQLSKGQRIDLTKTNPGLTKALIGLGWDTNKYTGGADFDLDASAFLVDQNDRCINDHDFVFYNNLEHPSGAVIHTGDNRTGEGEGDDEQIIVDFSKIPAHVEKIGITVTIHEAESRSQNFGQVSNAFVRLVDESTNEELLRFDLGEDFSIETAVVVCELYRHGGDWKFNAIGSGFSGGLASLCRNYGLQV

SEQ ID NO: 4519 - protein, 257 aa, Bacillus licheniformis
MDLFHHIMSIYASFFDWEMWVEVLTDPVSWGLIGSLVVLEGLLSADNALVLAVMVKHLPEKQRKKALTYGLIGAYFFRFLFIGLGMILIKFWWIKLLGAAYLAWLVIKHFFIGEGDDEANAIKKDSWMVRVFGVFWATVISVELMDLAFSVDSILAAFAVSEKVWVLLIGGMLGILMMRTVAKFFLTLIDKVPELETTAFVLIGIIALKMAASVWHIEMPHSVFFIILIIAFAATFIIHYMNKQKAVKEQTAASKEE

SEQ ID NO: 4520 - protein, 393 aa, Bacillus licheniformis
MQYFDFLSASQKEDVFFKLPGTVTKDSPKRILEYALGAALYVPGNRKDIADVIINNKYPELCSVVFCLEDSIGDCEVLQAENNLVSQADMIYQAQKLQNINSDVLPLMFIRVREPEQMLELGNKLGRALHLFAGFVFPKFSMLNAEHYLDTLTKLSQESGIVLYGMPIFETPDLLAMETRAKALQELKSTLGFYQDIILNIRIGATDLCGLYGLRRKPETPIYDILVISDFIKDIVNYFGLQFVISGPVWEYFGDASRTVPPFAPNWAEAGESSLVINRYMDGLINETLLDLANGIHGKSVIHPSQIKAVQSLHVISMEDYLDALSIVESADGTRGVVKSSFSNKMIEIKPYLSWAKKILLKAEIYGVYHENRSYTDILRASKPFSNLGSFGS

SEQ ID NO: 4521 - protein, 534 aa, Bacillus licheniformis
MNQEINIQNALVNDDEWKQIIKKPLPERTPYEKNSHLTISRLAGRILGTPHDETDYYIYLHELYASGDVHVLSETLDKTISPERFQAIQRIHMVNQKEKGLSVNRFAAFLDGEQLIPKHPDPAMHRHLRKALIEVLQLFQSFHEKGLNDPDFRRVLLDLVKWMGNHLEKWLKGADCETAMPKVVWYGDTTKSQRYFLYYLMLVGCDVLLFHPEGKDEFRQLDPEQKLSFVFTYPDTSALEPFPTEKPQRKATVAYRSAKELDTVLHNEDSLMYKPWQFREHTPASVTLKTTYDELFLIAKERAFIRPNFQASKSTVNIPNLFAMVMGVSSNEKEYWDRLQTLTEYKESHTIRRFPFTKEETSNYQFHYSDALDQTGMIDPGRLMESNIWRYKHLPEGVQRGIAQAVSRMCKSPKMLALNNEKTADVQLYLFTQAVQLPAALLNMIQTFDYSQTVPKLILYHTEQTGTLTRSDAAALLLLNEIGIDIIIYNPPGHKCIDHYIDRQHFDTHWLDEMSFNQEFKEPSIVRKFINKIF

SEQ ID NO: 4522 - protein, 364 aa, Bacillus licheniformis
MANPNETSIVNISKEEEITVEKAEDIRAKLRQEPDVQALARQIDVKNQVELLEFGKEPALEISKFSDRILSMMRTNSVTDSGAMLTQLGKIMDRFDKNDFEEQKGLLSKLFKRGNSMIEKIFKKYQTLGGEIEKINVEISKYKDEMTKSTVTLDEMYESNLKYYVELEKYVVAGQMKIEELQRLIPEYEAKAASGNQMAQMELDTLRNGIQALEERVYDLDMARMVAIQTAPQIRLLQRGNTKLIGKINSAFIITIPIFKNGIIQAVTAKRQKLVADSMSELDRRTNEMLKRNAENISSQSVEIARMSGRPSIDIETIEQSWNTIVKGMQETKQIEDENKRLREEGAKRILELQDNMKKAALNG

SEQ ID NO: 4523 - protein, 233 aa, Bacillus licheniformis
MAALWLAFGGGFLSFISPCCLPLYPSFISYITGISVGDLKNRHAKHIKQSVMIHAAAFLAGFSVIFYILGFSASSVGLLFLQYHNLIRMLGGIFFVVMGLFLLGVFRPAFMMKERRFSIRKGKIGLLNSMLVGMIFAAGWTPCIGPIFGTIAYANFQNPDFGSAFMMITAYSLGFAIPFLLMAFFIGNIRPLMKYSNMLMKIGGALMIVIGILLYTDNMIWINIWYSNLTNLF

SEQ ID NO: 4524 - protein, 228 aa, Bacillus licheniformis
MEWKNPWNKKQLVCLFLIAFAAVPIFIEYLLKNALDLLLGEGMLSAMLMSIAMAAVFILSLYYIALKPDRLSWREIGISRFAPAYLIQIAGWTVFLIVMTFAVMEILIWFGAGYENTKTKTITADPSWLSIAMSFASACIVSPIYEELFYRGFLYRWFRAEFGVVWALVASSALFMIAHIPTYNTLAVNFGTGLVFAWTYEKTRSIIPAMIIHSLFNAILLFFTILLT

SEQ ID NO: 4525 - protein, 245 aa, Bacillus licheniformis
MKEELTTGRVAKMMGISVRTLRYYDQIGLLKPGSTLPNGRRQYSKEDLLELEKIMILKSAQFSLEHIKTLMNQLDTISIIEMHKRRLNSEIEQLTKSLEHTNTLLNMYQIEGSLSWEDLLKLVRQPRHKPWKESFSEEEAEILAERLPKAESDDFITKQWLSIIKRIKLCLKQEVPPESEWGKQIAEDIICLSDHSFKGHEDLADRFWEVRKSEEPNGLYPLDSGIMEFAERAIESAFHDSGGSG

SEQ ID NO: 4526 - protein, 401 aa, Bacillus licheniformis
MKLADLRKSGHAPSLLSSFLYFDVSFMIWVLLGALGVYVTADFDLSPSQVGLIVAIPTLAGSFFRIALGILTDRFGPKKTAVGGMLVTMIPLLWGWQFGSSVAELYIIGILLGVAGASFSASLPMASRWYPPHLQGLAMGIAGAGNSGTLLATLFGPRLAEQVGWNGVMGLALIPLTLVLFSYFLMAKEPPNQPAPKPLKDYFAVFKERDTWYFCLLYSVTFGGFVGLSNFLSYFFASQYAVPAVRAGEFVTLVVASGSCLRPVGGLIADKIGGVRLLQFLFIGVALCMFSVSMLPSLGVVTAALFIGMGCLGMGNGAIFQFVPQRFQQEIGMVTGIVGAAGGIGGFFLPNILGTLKQITGTYSSGFLTFTVIAFLALGLLLFAQAGWKKQWKAEEKSIRI

SEQ ID NO: 4527 - protein, 319 aa, Bacillus licheniformis
MRNQKVNRTVLIGAGFVGSSYAFTLINQGITDELVIIDLNKDKAMGDVMDLNHGKAFAPHPVKTWYGTYDDCKEADIVCVCAGANQKPGETRLDLVEKNLKIFKGIIGEVMASGFDGIFLVATNPVDILTYATWKFSGLPKERVIGSGTTLDTARFRYLLSEYFGVAAHNAHGYIIGEHGDTELPVWSHANIGGVPVSDLLKRNEKYKAEDLDELFDNVKNAAYHIIEKKGATYYGVAMSLARITKAIYRNEEAILTVSAHLDGEFGENDVYIGVPAVVGRCGAREIVELDLNEKEKQQFKHSAGVLKAILKPHFELQA

SEQ ID NO: 4528 - protein, 542 aa, Bacillus licheniformis
MKMWQQIYDPFGNLFISAFAAILPILFFLLALTVLKMKGIIASFLTLAVSFIVAVFFFHMPAAKAVSAVLLGIANGLWPIGYIVLMAVWLYKISVKTGKFKVIRASIAGISSDQRLQLLLIGFSFNAFLEGAAGFGVPIAISAVLLVELGFKPLKAASLCLIANAASGAFGAIGIPVITGAQMGGLTPVELSRTLALMLPVIAFFVPFLLVFILDGFKGIRETLPALLVLSGSYTAVQTLTMISLGPELADILAALISMGALALFLKKWQPRHIYRETGNEHVPAEKYRAADIMNAWSPFYILTAVIAVWSLPGFKGLFQEGGFLKQTTILFNMPFLHREVLKTPPISPEQAPLDAVMKLDFISATGTAILIAVIITIVMSRNISFRGGLSSLKETVKELWLPVLTICFVMGFANLANYAGLSSTIGLALAKAGDIFPFVSPVLGWIGVFITGSVVSNNALFGHLQAVTGAQIGTSSALLLAANTAGGVMAKLISPQSIAIATAAVKETGQESKLFSQTVKYSLVLLFIICIWTFALSKLGI

SEQ ID NO: 4529 - protein, 213 aa, Bacillus licheniformis
MLNIFLSYVFLGLSLAAPVGPVNAAQIDRGMKGGFFHAWLFGLGAVTADVLYMALIYFGVAQFLTAPFLKTFLWLFGFFVLTYTGIESLVKAKEVSLMRGAGEKGSYRKSFLSGLVISLSNPLSIMFWLGIYGSILAKTVEAYESYQLLICSSGILIGLFLWDLAMSFLAGTFRTFLSPRMIQGTTWLAGISLIVFGCYFGYQGILELLQAGR

SEQ ID NO: 4530 - protein, 444 aa, Bacillus licheniformis
MKRQAKKGDLKWWQLSMIGVGCTIGTGFFLGSSIAIKKSGFSVLAAFLLAALGTFLVFQQLAKLTADHPVEGSFCSYAREAFGNWAGFSNGWVYWSSEMLIIGSQLTAISLFTRHWFNEIPLWVFASIYAILGLIVIFTGRSSFEKTENILAVLKTAAILMFIIIAVLALCGLLPGKTPEVQFPDRVHELFPFGFMGLWTGLIYTFYAYGGIEVMGLMAIHLKDPKDSSKSGSLMLITLAVVYVVSIGLAMLLVPRGTFTEQNSPFITSLKDFHLDLIMDIFNGIFIIAGFSTLTASLFAVTTLMGTMAKNGDAPACFAKKEKAKVSWPALGLTVLVLAASIVLSLILPKQLYEHMTTAASLMLLYNWMFILLSSKKLTKPKMKGNVQIVTALVLILFAVSGTLFEKNSRPGFFVSLLFLAVIAAVTMLMKKKWADQEEKNGQT

SEQ ID NO: 4531 - protein, 272 aa, Bacillus licheniformis
MTLQEKIMQELNVKPSIEPKQEIEKRVGFLKSYLKKTGAKGFVLGISGGQDSTLAGRLAQLAVEELREEGIQAEFIAVRLPYGVQQDEDDAQLALKFIQPDKSFAFDIASTVGSFAAQYQSVTGEALADFHKGNVKARVRMITQYAIGGQNQLLVIGTDHAAEAVTGFFTKYGDGGADLLPLTGLTKRQGRSLLEELGAPERLYTKSPTADLLDEKPQQSDETELGLTYDNIDDYLEGKAVSSEVAEAIEKRYKASEHKRQVPASMFDDWWK

SEQ ID NO: 4532 - protein, 177 aa, Bacillus licheniformis
MNAAIRDKNIVLIGFMGVGKTTIGQLVSKKLGRDFIDIDHEIEKDFQMTIPEMFQQKGEAFFRQTEKEYIFQMCEHTMGNIVSLGGGAFQQEEIRKKCLEHCFVIFLDLRWENWKQRMDLLIENRPVLHNRTIEEMKQLFNERKSIYAFHHLKVETDNRSAEETADYIVEMLKLGQS

SEQ ID NO: 4533 - protein, 256 aa, Bacillus licheniformis
MKQRIEEELKNIEATYGVKILYAVESGSRAWGLPSQDSDYDVRFIYVHQKDWYLSIDAKRDVIELPIDDSLDISGWELTKALRLFRKSNPPLLEWLSSGTVYYEAYSLAEKMRRLKSRAFSPVSCMYHYLNMASGNFRDYLTREEVKIKKYFYVLRPILACQWIESRRTVPPIEFQVLLDELTEDGPLKTEIHQLLERKKKGEEFNLEPQNPILHEFIERELERLQTVAKAYKTDHEDLTQELDRLFRETLDEVWA

SEQ ID NO: 4534 - protein, 305 aa, Bacillus licheniformis
MEVITRDFFLFLSKSSILNRLARNWGSSVATGKIIGGKDFEASIPIIKGLNEQGLTVTVDHLGEFVNSREVARERTQECIRAIQLIAQEQLNSHVSLKMTSLGLDIDLDLVRDNMNSILECAEQHQVMVTIDMEDEVRCQKTLDLFKEFRQKYEYVSTVLQAYLYRTEQDLEELNSLNPFFRLVKGAYKESPKVAFPDKKDVDENYKKLIKKQLLSGHYTAIATHDDKMIDFAKEIANEHQIGKDRFEFQMLYGMRSKTQLELVKEGYNMRVYLPYGDDWYGYFMRRLAERPANIAFAFKGMTKK

SEQ ID NO: 4535 - protein, 516 aa, Bacillus licheniformis
MTTPYKHEPFTNFGIEENRKAFEKALETVNNEWLGQSYPLVIDGERYETENKIVSINPANKEEVVGTVSKATQDHAEKAIQAAAKAFETWRYTDPEERAAVLFRAVAKVRRKKHEFSALLVKEAGKPWNEADADTAEAIDFMEYYARQMIELAKGKPVNSREGERNQYVYTPTGVTVVIPPWNFLFAIMAGTTVAPIVTGNTVVLKPASAAPVIAAKFVEVLEESGLPKGVVNFVPGSGAEVGDYLVDHPKTSIITFTGSREVGTRIFERAAKVQPGQTHLKQVIAEMGGKDTVVVDEDCDIELAAQSIFTSAFGFAGQKCSAGSRAVVHEKVYDEVLKRVIEITESKKVGEPDSADVYMGPVIDQASFNKIMDYIEIGKEEGRLVSGGKGDDSKGYFIEPTIFADLDPKARLMQEEIFGPVVAFSKVSSFDEALEVANNTEYGLTGAVITKNRDHINRAKQEFHVGNLYFNRNCTGAIVGYHPFGGFKMSGTDSKAGGPDYLALHMQAKTISEMF

SEQ ID NO: 4536 - protein, 482 aa, Bacillus licheniformis
MIISIVIYMVGMLYIGYYAYKRTANLSDYMLGGRTLGPAVTALSAGASDMSGWLLMGLPGAMFATGLSGSWIVIGLVLGAWANWIFVAPRLRSYTEVAGNSITIPAFLENRFHDKSKILRIFSGVVIITFFTFYVSSGMVSGGVLFNSIFNLDYHAGLWIISGVVVAYTLFGGFLAVSWTDFVQGIIMFVALILVPIVTVIQTGGPGEAFSEIQSIDPNLLNIFKGTSVLGIISLFSWGLGYFGQPHIIVRFMAISSIKETKKARRIGMGWMIFSSAGALLTGLLGIAYYSKNGLHLDDPETIFIQLGNILFHPLITGFLISAILAAVMSTISSQLLVTSSSLTEDLYKTLFKRSASDKELVFFGRLSVLAVSIVGLCLAWTKNNTILGLVSYAWAGFGASFGPVVILSLFWKRMTKWGALAGMVAGALTVIIWAEAGLSDVLYEMIPGFAASLLFVFVVSLLTSKPEQQVLDEFEQYKQTL

SEQ ID NO: 4537 - protein, 414 aa, Bacillus licheniformis
MEELLEQVVSLSNINEIIDFISGELKKPVILESADFFLLAYNSYYINHFDAANQQTIFSKKCPLPIFEKFVEEGIIDQLKTIPTPFRVKQIEEIGLNQRVVVSAKHKDEIMGYIWVQEIEDNLSDEELDFLYQASFHVGKIIYKKKRLKQEKEEQAEELYKKAINDQFQTEKELKAAADKANVVLPAVFTVMVLQVVDGEDELLEDLKETIRSYLNLKDNISHVLEDHSNIAIIVGSVSRKRSALAAASELINRLLTHLRSQMLPLILIGVGNEYSSLLSLGKSYREALQVTKAAEITGSQEHIPYEYQKLGLFKYLDQIAAKNDHLQYVNPDLQLLKEKDKESHTEFLRTLEIYLVNNCKVKPSAEQLFIHQNTLNYRIKQILEMTSIDLNDFNTRCQLFIDLMLMKKAGYKS

SEQ ID NO: 4538 - protein, 281 aa, Bacillus licheniformis
MFRTFILMLFTFFFFHLHASGNLTKYINMKYAYLSYIAIILLAILTAVQFYIYMKSSDEKGCNHECGCGHDHDHEKDKPFLQRMFIYFVFFFPLCTGLFLPAATLDSNIVKSKGFSFKAIEQPEHYAQTQYLRPDTSIYYGQDGYDELMNKALKKYKEKQHITLKDDDFLKGMETIYHYPGEFLDRTLEFDGFAFKGEAISDKQLFVLRFGIIHCIADSGVYGMLVEFPENMDIKDDQWLHVKGTLSSEYYQPFKSTIPVLKVKDWSAIKEPKDPYVYRTY

SEQ ID NO: 4539 - protein, 303 aa, Bacillus licheniformis
MDLRGGFFVASQSFLQLNSIFISILIEAIPFVLIGVFISGLIQMFVTEEMMAKIIPKNRFLAVLSGTFAGVLFPACECGIVPIARRLLLKGVPLHAAVAFMLTAPIINPIVLFSTFIAFGNKWDVVFYRGGLAIAVSLIAGLIISYQFKGNQLIENGTHGHHHHVHESQSFLQKLGGTLRHAVDEFFSVGKYLIIGAFVAAAMQTYIKTSTLLAIGQNDVSSSLVMMGLSFVLSLCSEVDAFIASSFSSTFSLGSLIAFLVFGAMVDIKNLLMMLGIFKKRFVFVLIPYIAVIVLAGSLLVKG

SEQ ID NO: 4540 - protein, 318 aa, Bacillus licheniformis
MQQPYDMPLEQLYQYKPERTAPADFKEFWKGSLEELANEKAGPQLEPHEYPADGVKVYWLTYRSIGGARIKGWYAVPDRQGPHPAIVKYHGYNASYDGDIHDIVNWALHGYAAFGMLVRGQNSSEDTEISHHGHVPGWMTKGILDPKTYYYRGVYLDAVRAVEVVSGFAEVDEKRIGVIGASQGGGLAVAVSALSDIPKAAVSEYPYLSNFQRAIDTAIDQPYLEINSFFRRNTSPDIEQAAMHTLSYFDVMNLAQLVKATVLMSIGLVDTITPPSTVFAAYNHLETDKEIKVYRYFGHEYIPPFQTEKLAFLRKHLK

SEQ ID NO: 4541 - protein, 140 aa, Bacillus licheniformis
MNTEQTIEVMNQNWTDIYYHLHMKHDDQLSHQAVRMLQHIEKNRFVTIGHLARLLDVSHNTASEHVKRLIQKGLVQKNRDSSDERKVYVTLTPEGEEAVKRHTRLNPKKLQKVLEQLNEEEVEMVKTAFSLLSREAKSCF

SEQ ID NO: 4542 - protein, 101 aa, Bacillus licheniformis
MIAIITEIARKSPEMGGMIAALPLVSLLSLFWLSVQGESLKHLSQFAKGVLWGFPATAVLLLIVVLSLKASFPVIISVVFGICGWGGCLMLQKALIHAIFG

SEQ ID NO: 4543 - protein, 146 aa, Bacillus licheniformis
MISHAPHPDRLPAHPAYIEPVNCQIYSGSASQTGLIYLSDKAGNPVEKSGREGLYISLVNQEAHRLKGYLYYFQNGEYQEFMISQTKAQAFSYELAPETVQTYPINLKILGSNYFRFLSTSIPPDGAYRDAPFPARMIYYSRLYTW

SEQ ID NO: 4544 - protein, 227 aa, Bacillus licheniformis
MGSIQWEYIFNAELAAKSFPYVMQGIWNTLFISFASMFAGLILGFFIALGRMSGLALLRWPARIYISFMRGVPILVILFILYFGFPYIGIQFTALAAALIGFSINSAAYIAEIIRSALSSVDRGQWDAAKSVGFSYWQTMRHVIVPQSVRIALPPLANVMLDLVKASSLAAMITVPELFQQAKIVGGREFDYMTMYILVALIYWAICSGIALLQDFLEKRTEVYIKK

SEQ ID NO: 4545 - protein, 291 aa, Bacillus licheniformis
MNKLHTYKRITLLITVLALALITAACSTAQNKAENKKTAWDEIKEKGKIVVATSGTLYPTSYHDTDSGKDKLTGYEVEVIREAAERLDLDVEFKEMGFDGMLTAVGSGQVDAAANDITMTDDRKEKFLFSTPYKYSFGTAIVRKKDLSGIHTLEDLKGKKAAGAATTVYMDIARKYGAEEVIYDNATNDQFLKDVANGRTDVILNDYYLQKLALAAMPDLDLTIHPDLKYYPHQQGMIMKKGNTELKKQFDKTIDEMLKDGTIKKISKKFFGGADVSKKQDIDYIDVDVNK

SEQ ID NO: 4546 - protein, 183 aa, Bacillus licheniformis
MKNILIINGHEAYPHARGQLNHTIFTAMADKLSEKYEVKKTVVADGYQIPEEHEKFKWADAVIYQTPVYWFSVPALFKKYIDEIYEYGLFYQGSEDYGRGGLFTDKKYMFSTTWNAPKDVFSKAGTFFEGKSLDEALFHLHKMQEFIGMKPLKTFSVHDVISNPQVDQYLADLDAHLKEVFSI

SEQ ID NO: 4547 - protein, 241 aa, Bacillus licheniformis
MFLKKLTLLREGVPSYAKYPFSIPAIQHLKELTFQKNVTFFVGENGSGKSTLLEAIADKCEFNTAGGGRNNTYEVYGSGSALGDYIRLSWLPKVTNGFFLRAESFYHFATHIDEVDITGFRSYGGRSLHEQSHGESFLSLFKHRFKEKGIYLLDEPEAALSPARQLAFLKIIHDLTKSSQAQFIIASHSPILLGYPEAEIFSFDGEQIAEVNYEDTDHYTLTKYFLQHREKLLAELFLDDV

SEQ ID NO: 4548 - protein, 478 aa, Bacillus licheniformis
MIHQRLRPFPDHFLWGSASAAYQIEGAWNEDGKGLSVWDVFTKIPGKTFKGSNGDIAVDHYHRFKEDVALMAEMGLKAYRFSVSWPRIFPQGRGEANESGLRFYDDLINELLAHDIEPVLTLYHWDLPQALMDEYGGFESRRIIEDFNAYCVTLYKRYGGRVKYWVSLNEQNYNFNHGFITAMHPPGVKDRKRFYEANHIAFLANAKAIDSFRRYVPDGKIGPSFAYSPAYPLSSRPDDILAFENAEEFTNYWWLDMYCRGTYPDIPLKYLKEKGWAPTIEDGDMELLAKGKPDFVGVNYYQTITYEMNPLDGVSEGKMNTTGQKGSNQETGMPGLYKTKRNPHLETSNWDWAIDPIGLRIGLRRISSRYGLPLFITENGLGEFDKVENDGTIHDDYRIAYLRAHLEQCRQALNDGVDLIGYCSWSFTDLLSWLNGYQKRYGFVYINRDEENVKDLKRIKKDSFYWYQNVIQTNGEEL

SEQ ID NO: 4549 - protein, 132 aa, Bacillus licheniformis
MIKKWEAQEMTMSYHQFTVYQKGGKPPVMDWTDEDIKRGYTTGEHAVSFEALENTASSVEVRLNAQKQVPSFNRRVTVPFEVLYDGVEIASVLSKKLTCDIPQGAYQLTCYTIMPDHSGTAQITYLLDFKQA

SEQ ID NO: 4550 - protein, 148 aa, Bacillus licheniformis
MDKIKSLLITLLAVAVVIIGIVSGDFFTSEHQPSGRQNGSNYDEVLIFPSDRYPETGAHIRKAIKKGHSEICTIDRDGAAERRKDSLKDVPSKSGYDRDEWPMAMCEEGGTGASVEYISPSDNRGAGSWVGNQVSDYPDGTKVLFKIN

SEQ ID NO: 4551 - protein, 267 aa, Bacillus licheniformis
MKTLIRWLFDRPLKKGTVLEGRYRINRVLGMGNYGITYLAEELGRSGFRVIKQQRKTKAWTSAGRRSFNREAEILRELDLPAAPRLYEVLRAAGERFIVMEYIEGKTFEDLLFYDGRVFDEQQTISILKEVLHSVSLLHSRGIIHRDLRIPNLIVNRGTIRIIDFGLACRLTERERVDNRHPEKKLMRAVSVKSDFYALGHFALFLLYSGFTPSDEEEKCWEEELSISSGLKSVLRKMLQIDLPYERAEDIIGDLISCTAEKKKLPF

SEQ ID NO: 4552 - protein, 392 aa, Bacillus licheniformis
MGTKINLLVLAVILIFSSALGIFIIKELSKELEQMATEKAKSDLKLSYRYLNESLEGDWEVKEDRLYKGSTLINGNEELVDQIGNDTKDTVTIFQYDTRVSTNVTVDGKRAVGTKVSSEVANAVLKEGKNFYGKADVAGKTYQTAYMPIKDKSGEVIGIFYTGADQDMITSTLQSFLKIFAIVLTASIIISILLVLIFTKRIGGRLRMLTHAFEQAGSGNLTTEIQDDSTDELGDLSHHFNQMNDSLNRLMQKISQSSHSVAAASDQLTSGAEETSLASEKITEAVQHIASSSEMQTSGIAGSKQAVEQVSADIQNISENAAILNEKSQYARKKAKQGAKDISETMRQIHTMHQSVHESGEIIEMLKIQDHMKSAAFQKRSRRLPIKPTCSL

SEQ ID NO: 4553 - protein, 246 aa, Bacillus licheniformis
MKVYEAETLISAMKQRSDEYKNLREQLVSLKKALNSVAELDEFQGKGADAIKAFYRDLSGVVDGWLDLTDMQIQFLNGVSSAAENAGLSEDTFVDVQFLEQELANVHIHSQNMVSAQQQELSNILGQIDDLISLQPFSSDEIKQQLDAANQNRKDTIKAVEDLDGLLKREYSASEHIQQMIQTDYSALIDATGKGKNASPLNYNSHIYQNSEVYKMKHRMHQEARSYIANKQKQYETGKAEKAEEL

SEQ ID NO: 4554 - protein, 684 aa, Bacillus licheniformis
MNEEGYRLGIDIGGTFTDLTLLNPADGSMTAVKTPTVPEDPARGIINGLALLKTRGVQPSEIHHFVHGMTIGLNTLLQRKGADIALFVTEGFRDILSLQRLRLPVPYDFRSRMPEPLIPRKNVFPIQERMLYDGSEKLPLHMEDIDEAVGQALRKGLKGIVVSFLHSYRNPLHERQAAERIRQIAPELEVATSAELWPQMREYERTVMSVANLYIKPNIHHYFGTLKERLVQEGISAQPFITQSNGGLMDIESAAEAPVKTLFSGPAAGVIGSIRTAEAAGEANIITFDVGGTSADISIVEKGEPTFTQSNQISGFPIAIPSVAMYSIGAGGGSVAWIDSGGLLKVGPESVGSDPGPACYGKGTKAALTDAFLICHYLNPNRFAAGNMKLYRERAEKALLPVAEYLGTDVEQAADKMIQVALANMYTELSNVMEQHGFDPREFSLMAFGGAGPVTANFLAEEIQAKNVLIPPHPGTLSALGALTADFIYDAVCSRQVLLEQIKTAELKVEFMRLQEQAETWLRKQRADMVTEASLLYLLDARYKGQAYEIELPVSPEWLEGESTSEIADSFHLLHGKQYGHSDGKASIELMNMRVRIIGKTPKPPGGKGCQSNLPEAEPVSQRKIIMKGGTYQASVYRRPDLRSGQRIDGPAIVEQDDTTTLILPNWSGKTDHAGNLIIERKES

SEQ ID NO: 4555 - protein, 664 aa, Bacillus licheniformis
MRTDPARLEMMRSYFNAIAAGMGHVIERTSFTTFVKESADFATALATPEGEFFVYPKTVGVTIFLGLSLKRVIEESGPFEPGDIILTNDPYTTDGLATHLPDIHVVKPIFLEGEIISYAWCFVHCSDVGGLVPASISPTATDIHQEGLRIPPARIYKKGRENRDILKVLRANSRVPDLNEGDIHAMVAAVNTAENRLTEMVGKFGKEAVQQGMDDLLEQAAMRAGRVISRIPEGSYSFSDYLDDDMVSDVPIRLAVTANVSGGEITLDFSDCDPQVKTAFNLVTNGSKHSFLYQGLINYIISEDPYIPINGGLTRPIQVIAPKGTLVHPEYPAAVGIRHSITMRLYNAVLGALAKALPKAVPAAGAGQSAIVVLSVPDESTGSRKMSVVEPMGGGGGGQHDMDGADGIDHASGFLKNTPIESLEQHIDIHVRRYELIKNTAGAGFHRGGHAIGLEFEAAAPESIVTARGMERMRFHPWGLAGGTAGALGRVRLYPDQPQEKTMSKIDVLKLNKGDVISIHSPGGGGWGNPFRREAESILGEVEAGLLSPEAAYHQYGVAVKENGAGSFIIDLEETAEIRKKKAGEHRKQWDFGIAREEYERCWTEEASSTLARLLRQLPAHQRSHVKHLVHRYFSKEHNGPISKSEVAAAVEKLAGKNNTGMVR

SEQ ID NO: 4556 - protein, 362 aa, Bacillus licheniformis
MTMKSKISALFILSLAAVLLLSGCGGNGSQESKQSDTVVIGVYGGDWEKHIKPSLESFEKETGLKVKVVAGTDSEWFTKLKASNGRNAPYDLLILQPDTIHRAQSAGLLAPIDQEKVPNVRDLYHSVQKRFTDDGKQYAAGFSMGQLGIVYRKDLVPQEPKRWTDLWNSSYKGHVAISSPAYSAGLQFFVGLINAQGGLESNGKDVDKAFNSLADLKNNITAYPDNPGSIQTLLERGDAWVVPFWDGRAFSLQDAGLDLGFAYPEEGAVAAVASWALMKGSPNQDNAYKLLNHLLSPEVQGDFADRTFYGMANKKVKYSDKLKGKIKVGEDYYRNLKWVDYEVAAKDLGDWTNRWNQVLGGK

SEQ ID NO: 4557 - protein, 372 aa, Bacillus licheniformis
MSAIQIRHVSRHFGNTIALEDVQLEVKEGEFFSLLGPSGCGKSTLLNIIAGFLEPTSGFVYIGGRDVTDLPPYDRHIGMVFQDYALFPHLSVFDNVAYGLKVRKWPRRKIEERVMECLALVRLEAFANRMPHQLSGGQQQRVAIARALAVQPSVLLLDEPLSNLDAKLRKEMQTELRSIQKRVGITTILVTHDQEEALSLSDRIGILGCGRLQQLGTPLDVYRTPANQFVAEFIGQVNLLKARASKIQPSSGGYGYETVDFEVYEGVPLTFEINQELSKKTSVLFMVRPERISVSFEKQKNRLIEMPATITEVSYAGHDLRLKAAVFKGEWIIQAPDPQFPRLPKAGDQVYLSLEPGDFVPLDVKEDADEGC

SEQ ID NO: 4558 - protein, 288 aa, Bacillus licheniformis
MRAVEQKRFYWFLLVPVLLFLGVFLVLPLVLLLLLSFRDVDAMMNTLDTYSFSQYVEVFSSDVYLKTIGITIWTALKTTVLCLVMAYPAAYLLVKAPTGRLRALFYILLVSPLLTSVVIRTFSWIVLLSQNGIVNEALISMKMIEKPLPLLWNMNAVIIAYVQVMLPFAVLPLASSLSEVKPDLKFASMSLGAGRLRTFFFVTLPMTVPGLLTGAMIVFSLSAGSYITPLLVGGRMQPLLPLSIYQQVMQVFHLPLAAAMSITLLAVVSVVIGILGIFQKRWEARING

SEQ ID NO: 4559 - protein, 263 aa, Bacillus licheniformis
MRRGKWIDACVWTAGLLVYFFLALPVFVIILSAFSPDEYPKFPPSGISLRWFAGVFSSSGWMESIWVSFMLLLVVTHLAVILGTVAAYALARLNFPGKQAIQAFVLSPLMIPQIALGVSFLYLLTMIGVNGTFAGLAAGHMLISLPYVVRTVGVSMANVDQKLELASMNLGAGPWHTFFHVILPLIKPGIIAGAVFASVTSFGEISISLFVSSPAVTPVPVRTFSYIDQTFDPSVHAISVIFITVSVIALIIIERTIGLSKTM

SEQ ID NO: 4560 - protein, 3580 aa, Bacillus licheniformis
MGNTFYPLTHAQRRIWYTEKFYPGTSVSNLSGFGKLKSASGIDSGLLTEAIRKFVRTNDTMRFRLMFEGEDEPKQYIAEDEPFQIEYFDASESGGADGVLKWGQAEARRPLPLYDSPLFKFAVVRISEEESWFFAKVHHIISDGISMTILGNRITDIYLKLAKGETDLEPVQSSFTEHIQSELEYENSKRFQKDKAYWNAQYEAIPEPVSLKASDTYQIQLDAARFSKEISPDLYKKIQTYCNEHNISVLSLFLSILHIYMHRVTGQKDVVLGTFMGNRTNAKEKQMLGMFVSTIPMKASIEVHQDFSAFVQERMKDQLKIIRHQKYPYNLLINDLRERQPHVSKLFAVSLEYQVMQWQQKETVSFLTEPIFSGSEVNDISIHVKERWDTGTLAIDFDYREELFTSEEMAVLYERLMTLLEDALLSPQKTIAELEIVPAFEKERLLKRASSQTIAYDKNMTLHGLFEQKAADHPEKTAVVYEGQKLSYRELNEQSSRLAMALRRRGIGPDAPAAIVMERSERVITAMMGVLKAGGAYVPIDPGFPEERIRFMLEDSKAKAVITDSGLTFETAETVQFSEALSESRENGYPSSAAGAGHLAYIIYTSGTTGRPKGVMIEHRQVHHLVRGLQQAVGTYDQDDLKLALLAPFHFDASVQQIFTSLLLGQTLYIVPKKTVSDGRALSDYYRRHQIDVTDGTPAHLQLLAAADDLSGVKLRHMLVGGEALSRVATERLLQLFAETAESVPAVTNVYGPTETCVDASSFTITNRTDLQYDTAYVPIGRPIGNNRFYILDENGALLPDGVEGELYIAGDGVGRGYLNLPDMTRDRFLKDPFVSGGLMYRTGDTARWLPDGTVDFIGRRDDQVKIRGFRIELGEIESVLQGAPAVEKAVVLARHETGGSLEVCAYVVPKQGGKIHIQGLREHLSKHLPDYMIPSCFVELNEIPLTASGKVDRKALLRHEVSVSGTAEYAAPRNECEEKMVGIWQEVLGAEQVGIHDQFFDLGGHSLKAMTMLAKIHKAFGVEVPLQVLFEKPTVAALSGFVSEAEKDGFAVIEPAPESDDYPLSLAQQRIYIVSQLEGVGYNMPAAAMLEGTLDSGRLEAAFQKLIDRHEALRTSFTVVDGEPRQTVHQRVQFKIEKVKAEGKPIEQIAKSFVRRFDLAKAPLMRAGLVSLADGRHLLLFDMHHLVSDGVSISIILNELAALYNGEELPELRLHYKDYAFWQRAQAQEGFQKEEAYWESMFAGELPVLQLMTDEPRPPVQSFEGDRVSAVLPKDLKEKLAVLAEQNGATLYMVMLSAYNMLLAKYSGQEDVIVGTPAAGRRHSDLEGIIGMFVNTLAIRSKVDPGRTFADFLNDVKKTVIDAFEHQDYPFERLAEKFGASRDLSRHPIFDTMFILQNAWEDIPLLGDLHLSIYETNFNIAKFDLTLQAKEEQGELILDLDYSTKLFKKDTAERMLKAYLNLLEDMAADPMLRIGEYSLLTEEETNRQLVAFNPATSDYPREKTIVQLFEEQAAERGGYPALQFEDKVWSYDELNRKANQLARRLRESGVQAGTTAAILTARSAEMVIGILAVLKAGGAYVPIDPDHPEKRVQHFFKDSGAAVLLTQKAMKPLAEAAEFGGDILFVEDENLYMGDASDLRLPISPEAMANLTYTSGTTGTPKGNMVSHRNILRTVKNANYLEVMESDIVLSISNYVFDAFMFDVFGSLLNGAKLVIAPKDTILDMSRLAHVLEKEKITILMITTALFNLLTDMRPDSLKGLRRVLFGGERASVDHVRRALKTVGRGRLLHMYGPSESTVFTTYHPVNEVPDDAQAIPIGKPVSNTEVLILDSFGNVQPAGVAGELCVGGDGLVRGYFNRPELTAEKFTAHPFKTGEKIYRTGDMARWLADGCLEFIGRIDHQVKIRGQRIELGEIEHHLLTHDMVQEAAVLAVDTGAGDQMICAYFTADQELSSQELRRHAAEGLPGYMIPSVFMQLDELPLTGNGKIDRRALPEPDIAQAAQKEYTAPRSGTEAQLADLWQEVLNVPKIGVHDNFFELGGHSLLGMTLIARIQQEMNVDLQLKDLFQAPTIESLAQAAAKSEKKSAVYIEAAPDRETYPVSSAQKRLYVLQQIEGAEKSYNMPAVLQLEGKLDLKRLESAAQMLIKRHEAFRTTFEIRNGEPVQRIWEAAELTIDVIDADEQEAEKLIKEFIRPFDLTKAPLFRMSIIRVTEEKHLLLVDMHHIISDGASVSVLIDEMTRLYAGEALEPLRIQYKDYAVWQQHLLTERHKMQEEYWLKELDGELPVLTLPTDYPRPSVQTFEGSRISFSLKPELVQQLRRLAKETESTLYMVLAASYSTFLSKLSGQSEVIFGSPAAGRPHADLSRIIGMFVNTLAIRTRPEGDKPFSAFLEEVKETTLGAFEHQDYPFEELIEKLNIQRDMSRNPLFDAVFSMQNADLKDLSMEGVTLKPYDFAHQTAKFDLTLTAAEEDGLLVFEMEYNTDLFKRESIKRWSGYWVNLLEAVAETPDASLSDLSLLDEAEKRRIVQKWNETKLAVPQDKTVHELFEAQVLRTPDRGAAVYNGVKWTYKELNARANRLARLLIEKGAGPEQRVGIMVKPSLEMAAGVLAILKAGAAYVPIDPGYPAERIGYVLKDSGAELLLTQTNLAVPEEFSGETLLLDSMLSEEITNDDEVNPQAGTQPNNLAYLIYTSGTTGQPKGVMVEHQSLVNLCYWHNDAFAVTEQDKSAKYAGFGFDASVWEMFPYWIAGAELHIIDEAIRMDITRLNEYFEENGITITFLPTQLCEQFMELDNQSLRVLLTGGDKLKRIEKRNYTLVNNYGPTENTVVATSTAIDPDEGMLSIGKPIANTRAYVLGQNNEVQPVGVAGELCIAGRGLARGYLNKPEETAKRFTEDPFVPGERMYRTGDAVKWLEDGRLEYIGRIDQQVKIRGFRIELSEIEVQLARLSEVQEAVVTDIEDAYGNKALCGYVVADEQLDTESLARKLGQTLPDYMVPAYWVQLDELPVTANGKVDRRALPQPDVEAQTAEYKAPRTETEQLLADIWQDVLGIDRIGVTDNFFALGGDSIKGIQMASRLQQHGWKLEMKDLFQHPTIGELSAYVQAADDQPIDQNPVEGEVTLTPIQRWFFERKFTNEHHWNQSVMLHAPSGFDPEAAGKALTKMIEHHDALRMVYQRNGDGIVQYNRGLEETAVRPEVIRFNESGAELEAAVLKESNRIQSSINLTEGPLLKAAIFETDQGDHLLIVIHHLVVDGISWRILLEDFAAGYAQAEKGEPIILQEKTHSFAEYAARLKEYARSKAFAKEIGYWQEVEKAETASLPKDDEAEDKRMHHTKTAEFSLSKEETEQLMTKVHEAYNTEMNDILLTALGLALKEWTGQEDFIICLEGHGREDIMEGLNISRTVGWFTSQFPALIQLRHSEDIGYQIKQIKEELRHIPNKGIGYGIYRYLTEEGKKAQPIKHDISFNYLGQFAEMADSGLFTRSALPSGDPLSPETEKPNALDIVGYIENGILTMSIAYHSLEYKESTVAAVAASFKTYLLQLIDHCLELDGGELTPSDLGDDELTLEELDKLMEIF

SEQ ID NO: 4561 - protein, 3588 aa, Bacillus licheniformis
MGKQKIQKVYPLTPMQEGMLYHAMLDPESSSYFTQLELVIDGEFDLGIFEKSVNQLVRSYDILRTVFVHQQLQKPRQVVLAERQAIVEFEDLADLDEERQKTRIDRYKQEVQAAGFNLAKDMLFKTAVFRLDRKKYHLVWSNHHIVMDGWSMGILMKRLFQNYEAFRANRTVPLDQGKPYADYIKWLGRQDKDEAASYWEHRLSGLESPSVIPGGKTRPDSGSYRNEEFTFVWDKDMVDALQKAANRYHVTAPNLFQAIWGTVLAKYNRSEDVVFGTVVSGRPSEIDGIEHMAGLFINTIPVRLRVDQNASFAELFKQAQQHAIDAERYDYLPLYEIQKQSALDGRLISHLVAFENYPLDKELESGTIHERLGFSIKAAGAFEQTNYDFNLIVYPGAEWTIKLKYNGEAFDAAFIEQAAGHLTRLAEEAIANPESKAGSADMLSKQEQQTLLAFNQTKTGYPREKTIPELFEEQVEASPDKTAVAADGRSLTYRRLNEKANQLARRLKARGLMHGNAAAIMMERSLEAAVSMLAVLKAGGVYVPIDPGYPEERIRFLLEDSGAKIVLTKDSPQISLEGYEVLAANAVDAEKEDAANLVHANKPGDLAYYIYTSGSTGKPKGVMVEHRNIVRLVKNAGYIPLKSDVKMAQTGAVSFDASTFEVFGALLNGGTLYPVPKETLLDGKRFRVFLEETGITTMWLTSPLFNQLAQQDPGMFATLNDLIIGGDALVPGIVNRVKRESPELSLWNGYGPTENTTFSTCFFIDQAYERTIPIGKPIGNSTAYIVDEHGALQPIGVPGELCVGGDGVARGYLNQPELTDEKFVGDPFAEGKRMYRTGDLAKWLPDGNIEFLGRIDHQVKVRGFRIELGEVEAALARLEGISEAAAVIRENNTGETEICAYYTAVGARPAAQLRTELSRSLPEYMIPAHLIELDSMPLTANGKVDKRQLPAPIAEETDRFEAPKNETEKILAAIWEEILGIKQPGIDDNFFSIGGHSLKAMMLTAKIQEQLQKEVPIKVLFEKPTIRELAEFLQGETKEKTAPIAPAPSRANYPVSSAQRRMYILNQLEEASTSYNVPAVLLLEGELDKERLEDAFRALISRHETLRTSFELIDGEIVQTIHQDAVFHLTESVADEAEAEAAIRGFIRPFQLNKAPLVRAELVKLEEKRHLLMIDMHHIITDGSSTGILIRDLASFYHGEEAPAPKLHYKDFAVWQNGPEHQEKLKEQEQYWLDIFKGELPVLDLPYDFPRPSKRSFEGDRVVFGINRKLTADVQKLLSEADATLYMFLLAAFNILLSKYASQEDLIVGSPVAGRTHPDLHNIPGMFVNTLALRNRPEGEKTFKEFLQEVKETSLQGFAKQDYPLEELIEKLPLPRDTSRNPLFSVFFNMQNMEIPTLKLGDLQISSYSVRHRTAKFDLSLEAVEHDGEIGLSFDYAVSLFKEETIRRWSGHFLNVIKTICENPGIKLRDIELLSDKERGLLLEEVRRSRAERLEERPFHVRFEEKAAEMPDQPAVVCGETILTYRGLDERANQIANVLRSEGIGKDDVVGIMLDRSAEVAAAILGVMKSGGAFLPIDPEMPTSRIQYMLEDSKARWLLTEHSHQAALADWYNGRLIDVRNDTLMASKKRPHLIHDGASLAYIIYTSGTTGQPKGVQLEHRNLANYVSWFISEARLSASDKTMLLSSYAFDLGYTSLFPVLLAGGELHIVRKETYTEPETFIHYIGEQGITYIKLTPSLFHTVVQPQSFALAKGLQSLRLIVLGGEKINPKDVERFHSRYPDTRFINHYGPTETTIGAIAKPVEPGMIRQFAERPTIGRPISGAGALVLDASRRLVPAGAAGELYITGSGLARGYVNNRELTAAKFIENPYTPGTFMYRTGDLVRRLPNGEIEFLGRTDDQVKIRGYRIELKEIEEAFIGLEHIERAVVLSFTADSGLDELCAYIQAKRQLPVSEMRERLSERLPSYMIPSYFVTVDKMPLAANGKVDRSALPEPQGLSGQSDSYRAPSTEFEKALCGIWEEVLGVRPVGLDDNFFDLGGHSLKGMMLTAEIQSKLGKKVPLKTLFDCPTAGLLARSIEADGQAEQSGIQPAEKRDWYPVSSAQQRMYALHHIEKNGTGYNMPSVLMLEGVLDTDRLRRAFADLVNRHESLRTAFVEIDGRTVQIVHEKADIDLKVIHIHEEDAEAQINRFIRPFDLSTAPLIRAELLSISSARHLLLIDTHHIIADGVSRSLFVKEIAQLYKGASLPEPKLHYKDYAVWQQQPDQQENIRKQEDFWLRQFKETVPELSLPLDFPRPPVQSFAGDRVHFKVSKGTALKIRRLMAKTNTTLNIVMLAVFNLFLSRLAGQKDIVVGSAAAGRTNADLKDVPGMFVNSLALKNHVPDQASFSGFLEEVKNNSLAALDHQDYPFEELIAKLDLPRDMSRNPLFNVMLTTEDPDKETLDLDGLIIKPYETSHAAAKFDLTLGAFEKDDEIGLQFEYATDLFKKQTIERWSGYLLNLLEAIAENPDASLSDLSLLDEADKRRILYEWNETVLDVPQNKTVHELFEAQVLRTPDRGAAVYNGVQWTYKELNARANRLARLLIEKGAGPEQRVGIMVKPSLEMAAGVLAILKAGAAYVPIDPGYPAERIGYVLKDSGAELLLTQSGLTMPDAFTGEVIDLNREASILAGELYPEDDINPSAEAQSDNLAYLIYTSGTTGQPKGVMVEHQSLVNLCYWHNDAFTVTEQDKSAKYAGFGFDASVWEMFPYWIAGAELHIIDEAIRMDITRLNEYFEENGITITFLPTQLCEQFMELDNQSLRVLLTGGDKLKRIEKRNYTLVNNYGPTENTVVATSTAIDPDEGMLSIGKPIANTRAYVLGQNNEVQPVGVAGELCIAGRGLARGYLNKPEETAKRFTEDPFVPGERMYRTGDAVKWLEDGRLEYIGRIDQQVKIRGFRIELSEIEVQLARLSEVQEAVVTDIEDAYGNKALCGYVVADEQLDTESLARKLGQTLPDYMVPAYWVQLDELPVTANGKVDRRALPQPDVEAQTAEYKAPRTETEQLLADIWQDVLGIDRIGVTDNFFALGGDSIKGIQMASRLQQHGWKLEMKDLFQHPTIGELSSYVQAADAKPIDQGPVEGEVTLTPIQRWFFERKFTNEHHWNQSVMLHAPSGFDPELVEQTLAALTEHHDALRMVYQKNNGRLIQYNRGPDDRSFAFRVVDLRYVTDIETEIAAQANRLQASLDLENGPLVKAEQYQTAEGDHLLIVIHHLVIDGVSWRILLEDFASGYSQAAQQHDVVFPDKTNSFKDWAEALEAYAQTERFLKTADYWRRLEQERICELPKDRAAAERKAENTSAVKFELSEAETRLLLTKVHEPYGTDINDILLSALSLTIREWTNGSNICINMEGHGREEIIPGMNISRTTGWFTAQYPVVLKSQAAAGLPETIKNVKETLRRIPDKGIGYGILRYLTDRKKAGAIFSIKPDISFNYLGQIDREVQTGFFGPSPYDMGRQVSERSEALYALSFSGIISKEKFILSCSFNTEEYDRQTIQELMDRFKAFLTALIDHCTAKEEREFTPSDFSAGDLEMEEMGDLFDVLEENLK

SEQ ID NO: 4562 - protein, 1282 aa, Bacillus licheniformis
MSQFKKEHVQDIYYLSPMQEGMLFHTLLHPGQGFYIEQISMQVKGSFQKDVLEKSMNVIIGRYDIFRTVFVHEKMKRPVQVVLKERSFQAEEIDLSGLSEAEQNERIEDYKRKDKEKGFNLSKDIPMRTAVFKKGQDRYEWVWSYHHILLDGWCFGIVVQELFEVYNALRENRPYSLGPVRPYKEYIKWLESQDKQKSLVYWEHHLAGFEGQTTFSEQRKNPEQAGNQPEELLFTLPKEDTEAFTQLAKAHHTTLSTALQAVWSVLLSRYQRSRDLIFGTVVSGRPADIQGVEHMVGLFINVVPKRATFGPQTTFTELVADLQKQALEAEPHQYVPLYEIQSHIAAPNLIDHIIVFENYPLQEANKQQKEKNLGFTMDEISVFEKSNYDLNLLASPGEEMMLKLAYNRNIFEPSFILRLKEQLLTAIREVIRDPEQPLDDICVVSKKEKERLLHEFNGQVQRKQIGLTIPQWFEQYAEALPEKPAVSAAGRTLTYRELNEKANKVAHLLRKKNVGRGEPVALLFRRSPEMVIAILAVLKAGGAYLPIDPEYPEARIQYMLEDSGAVCMLTQEELAGRAASLSFHKHTILIDDPAVSAESGRNLEIAAEPDDLAYIMYTSGTTGKPKGNLTTHANITRVVKETNYISLSEKDTLLSLSNYAFDGFTFDLYGALLNGAKLVVADQATILHIGKLTEAIQKENITVMFVTTALFNLLVDAGTGWMKGIRKVLFGGERSSVSHVKKAFAAMGPDRIIHVYGPTETTVFATFYPVNRMEDSAVSIPIGKPINETNAYILTENNRLQPIGAVGELCLSGTGVSRGYLNRPELTAEKFAPHPFNSGETMYRTGDLARWLPDGNIDFIGRIDDQVKIRGHRIELGEIEEQLMRCQGVKEAVVTARKSGNGDAALTAYVVPVQGTEVANEEVRRQLARRLPAYMVPAAYIMLEELPLTANGKVNRRLLPEADGRPNSTERRAPRNATEEKLAVIWSEVLGRQQIGIDENFFEIGGHSLKAMAVASRMLKDLAIDVPVNVLFEMPTIEGLAAYIDQGGHVDEVKKTVFNQASTRHLFAFPPVLGYGIMYGKLAEQMPEYRIHAFDFIESDDRAVRYAEAISDLQPEGPLTLIGYSAGCGLAFEVAQALEKNGRKVEKLLMIDSYMKNDVSDLEGRSIEADTAALMEANKDNEYMKIKTVADGIAKKMTAYYSYFVNLVHQGTVSSEIHLIKSEHAKPLPAWLSLWKEGTESSYDEYQGAGRHDEMLADGFVKSNADLIRQILGERAAVIGGA

SEQ ID NO: 4563 - protein, 246 aa, Bacillus licheniformis
MNEIIKQFGAPASGMQLICFPFAGGYSASFRPLHEHLKTDFDMLAIEPPGHGTNRMALVDNLEKLADLYIAALKPRLSSQFVLFGHSMGGMVVYRLAQKLEQEGIFPAAAVISAIQPPHIQRQKVSHQKDDAFLDHLIQLGGIPKELAEHREMMNFFLPSFRADYRALETFCHTDHTPLRSPVHILNGDRDEKCMRDALGWKKWANTIDFHYFKGGHMYLLSETEQVAAKLKTIAAASRSTAVPTM

SEQ ID NO: 4564 - protein, 303 aa, Bacillus licheniformis
MNKSAYAAALLYAFIIGFSFFFVKLALTAASPVDILAHRFTVAFLAALIPLLLGWVKIAISIKDALKVLPLALFYPVMFFAFQVFGLVYTSSSEAGIIQAAIPIFTMIFAAYFLNERFTKRQFFFTVLSAAGVACIFMMKSAGTGSSDLRGAALILLSALSSAGYSVLARKMTRTFSSLELTYVTTGAGFLFFNGIAGISHMSDGTLSGFFAPFTDPVFVLSVLYLGVLSSFATSFLSNYALSKIEAAKISMFNHLATLVTILAGIIWLGESLEWFHFAGTGMIIAGIIGATMVRRENRLKKS

SEQ ID NO: 4565 - protein, 449 aa, Bacillus licheniformis
MHKYVALMNELEDMIEDKSFQEGDRLPSIRALAIRFKVSKSTVIRALNELERRHLIYSVPKSGYYVVKKTNQRPNSGKAVIDFAASAPDPDVFPYIDFQHCINKAIDTYKNDLFIYGTPKGLPSLIQAVQKELANSQVFAKEEHIFITSGVQQALALLASMPFPNRKRKVLIEQPSYHLLIKYLEVHGIPAVGIERTAEGIDMDELERIFQTEDIKFFYTMPRFHNPLGTSYTEREKTAIVKLAEKYDVYIAEDDFLGDLENDKKADPLHYYDISSHVIYLKSFSKIIFPGLRVGAAVLPDSLTIVFNRYKQLLDIDSSMLSQAALEIYLKSGMFEKHKQKIRSSYQKRSCLLHDLLKECSASLGDVFEFHPPAQPAIHTHIELDRTIPASRLIKSLQKRDVLLEPVNAHYMPAFPKRNLLKINTSNVKEEDIRSGIERLRQAVETAYF

SEQ ID NO: 4566 - protein, 226 aa, Bacillus licheniformis
MKIYAVYMDQLPEAGQFNRMMAMVSEEKRKKVGRYRYPEDASRTLIGEVLARHIISETFHLPNEQIRFTEGRYGKPAAEGLNDFHFNISHSGKWIVCGAGAQPIGVDVEKIKPINFDIAKRFFSPSEHDDLMEKDESERLSYFYHLWTMKESFIKQAGKGLSLPLDSFSVKLNEQGRASVETPPGYPPCYIQAYEIDPGYKMAVCSAAPEFPGRIVMKSCAELSML

SEQ ID NO: 4567 - protein, 261 aa, Bacillus licheniformis
MIDGTLIKDTCFGRELLIYLPPSYGSGENRYPVLYVHDLGDLFDPAYSNSLRSIEKLFSSQEVPELLLVGVAPKDRESEYTPFPKRHLLPNKREYGGKGNEYAAFLANRLKPHIDRHYRTNPSREQTGIIGKSFGGLISVYTAFLASETFGKIGSLSGSFWFEGITEFMKNNRFENKHLRIYMDVGSTEGTDRDNLQKEMIPRTKEAFSLLTESAASEKELKFVIDEGGSHRLERFAKRFPEAVKWLFGSCHNSARNGRSF

SEQ ID NO: 4568 - protein, 127 aa, Bacillus licheniformis
MVDAAFKYGYSTPESLSGGLQPPSRHQPFTGPRKRRTLRAFPRLSFHIQIKGVEDMDYKIVEKEPFQVIGKALEVTVKDGQNKKDIPAFWNELNHNGFTDSLKPHIGPLGFLGVCMDFNDQPDTFNF

SEQ ID NO: 4569 - protein, 220 aa, Bacillus licheniformis
MKRELVLRWLFYFVGLIVLSFGVSLTIEGKVLGIGPWDAFHYGLYMLLGLTVGQWAIIVGAVIVGLTSLFTKAWPKIGAVLNMLLIGIFIDFFTYILPDPETYISSTVVFVIGVIFIGYGVGIYVSADLGAGPRDSLMLLISEKTGWNVQWVRNGMELTILLIGWLLGGPIGIGTVLTAILTGLILRFSLPQSKQLLKAAMAGRRIRAAKPVHMSLKKNG

SEQ ID NO: 4570 - protein, 176 aa, Bacillus licheniformis
MKKLYISAVLGLLFVFVGGTKIHAQEPQNNNGVLDENKFIDETVYSYTQPISIQDGEVTTQAKKYIKTVSVNRSYKSLLNIVVARHYSDTTFTYGSGKLYKSPRALSNDWWTLPPNFKSGSSKSWDWYNTGKGATGRSNLQVRYTWGVPTPWGPVGSNYSSRIKVSFKSNGSWYTN

SEQ ID NO: 4571 - protein, 182 aa, Bacillus licheniformis
MGTIGINFKNIQHQYRTKDVLRGVSFHADPSSITFLAGENGAGKTTLIKVALGLISPKAGNALFDGQSVGEIREKISCVFDEPPVYPNESGLDNLKFLSGIHSLDRKWSQEVCAMLKLDEGLLKQKAKALSLGQRHRLAVAAALLRKPKYLFLDEPSIGLDPPSWQLVQIALKQMTARDVQF

SEQ ID NO: 4572 - protein, 108 aa, Bacillus licheniformis
MQSGKIIFSGPIVKLVQAFPVYVRIVTDDHREIAVQFPEAEPDSSGIYRIVCESGEQARAVIDQVRRSTLNFQELSTEKASMGKMVTDIYKDGFQSEKRGLTYESVQN

SEQ ID NO: 4573 - protein, 299 aa, Bacillus licheniformis
MNPFKIETNQLKNSMLVRVCIALLFCCFIWGLLTLYQSAEGEERRQEKIHQSVIDEVKKNGAEEELENGGLEIEKNDDIARSMYIGLHPSVTPNLFLLILANIGPIVFIIIGSHLVGSEYHQGTVKMKAAHIGWRKAVSGKLCALLSLVIVMVIAALLLGLAGGWLAWTFATAHSDLAASLEVNAAVSYPILILFLMIGLTFYSVLGMTVTLLTKSRLAGVLISLAIPYAEQMMSLPFLPLTAYQSLMVHHFIYVDGSIIGQPYLTEPMGEPGAWAVLVCWLFVVIAVQQFAAKKQQIL

SEQ ID NO: 4574 - protein, 59 aa, Bacillus licheniformis
MALIFLVRLICLAFLACLALLFYAPFLAMPVWIALIIALIVCLYLAFIEEMKEWRRRKH

SEQ ID NO: 4575 - protein, 553 aa, Bacillus licheniformis
MQQRNTPDVQRWFPSEDGNEAKRNEFLSLIEQLIEGVDNLKNPDQVNLGGEKNREGFFYEKLVAESRIPHEGAPMKEVNEELLKLLHGHPYHTKYFFTNILPMASIPGILGMLTAFMVNGNNLWDVYGPAGAEAEVKVTAMMSKLAGYDAETSGGYTTWGGQGAVYSGLRIAIAKMAPSSLKEGVPGNFYAFCSEAAHYSLYKSMEAAGLGSDHLIKVKTNLDHSMDTEDLREKLRQVCEAGGIPVYIVATTGTTDAIGIDDVSAVRRAAEETAKSFGLPVPHIHADSALGGFFAFFNEYDLNENALSFSPGVLSMIKPIQEKMRHLHAADSLCFDFQKLGQTPYVTSLFLVKDRNDLKRIDLDPDETPYVGHRGYGDYHTGYTLECSRMASSISMYSALMAFGYEGYQKLLAQFLEVNLHFREQLSRQIPEADIVNPDNCGMSTLFRIYPEGAPRFEDEISGACTIEELERNNALTEKLFEKLGTKRDKMFFGDTKKHLLVKSCEGVELPLCVSKFFVISPYTMPEHVPGIIDYLKETIEEVFREHGSLMTN

SEQ ID NO: 4576 - protein, 574 aa, Bacillus licheniformis
MKTLKKKLTEHISVKIMIGVALVLLITIASFSAVFTFISKDLSEQLKQQFQNRLYTDIHLAENQIKRLDGNPLEIDSADGPLYKQTKMAVDSLKKKNKLENIYILSNEGGKERILVLSDTPDDFGTDYSFSPEMKEALTTNKETVSDVYEDEYGIHQSIFLPLENGSGEKVGILGIDLDASVIPETAAKAKWYTIAISAFVLLLGMVMAYFLGSYIAKPIRQLMKASEKIADGDLSADISVKSRDEAGKLAESFKRMSENLQQLIGHISASSEEVSKTSLQLKNVSAESSESAAQVAESMNSMSEGINEVVSSVSDCHTSAAEIDQQLTHVTEKVNEMKNVAEGVSKDSKTGQELVEETLRQTQTIKNVMEESKQAASEMQNHTEEIEKVIGMISSIAEQTNLLALNASIEAARVGEEGQGFAVVAGEVRKLSERSADAALSVSQLVAGTQESSRLVMERIQEGNEAVDKGQILINGTYENFSGIFKGISQFAERTDQLLQSLLKVEKSYQTISSAMEQISAVTEEQAAGSEEVAAAAEQQSAGMQEIASAIQQLSALSEELNQAASKFKLAAE

SEQ ID NO: 4577 - protein, 247 aa, Bacillus licheniformis
MLAIKGLNKSFGENEILKKIDLNIEKGKVIAILGPSGSGKTTLLRCLNALEIPNRGILSFDDFTIDFSKKNKPADLLRLRRKSGMVFQAYHLFPHRTVLENVMEGPVKVQKRNKEEVKKEAVQLLQKVGLEDKMDLYPFQLSGGQQQRVGIARALAIKPELMLFDEPTSALDPELVGEVLKVMKDLANEGWTMVVVTHEIKFAQDVADEVVFIDGGVIVEQGPPEQIFSAPKEERTKQFLNRILNPV

SEQ ID NO: 4578 - protein, 237 aa, Bacillus licheniformis
MAKMFLSNIQAAAIGQAIPWDLVRESFWPIFLRGIYYSIPLAILSFIFGMIIALITALARMSKSRILRAVFGIYVSAIRGTPLLVQLFIIFYLFPAFQVTIDPFPSAIIAFSLNVGAYASEIIRASILSVPKGQWEAAYSIGMTQKTALTRVILPQAVRVSIPPLSNTFISLVKDTSLASQILVAELFRKAQEIGAGNLDQILIIYMEAAFIYWIICFVLALVQQQIERRLDRYVAK

SEQ ID NO: 4579 - protein, 268 aa, Bacillus licheniformis
MKKAIFAVLLTLLITVMAACGASGDNSKDKNAAGDSLWSSIKDKGVLTVGTEGTYEPFTFHDKKTDKLTGYDVEMMQEVAKRLNLKAEFKETQWDSMFAGLNSKRFDVVANQVGKKDREDQYDFSDSYTTSQAVVVTKADNNDVKSEGDVKGKKAAQSLTSNYNDLAKNAGAEIEGVEGMAQAFQLIQQGRVDLTYNDKLAVLNYLKTSGNKNLKIAFETGEPQTTHFAFRKGSGELVDKVNSALKDMKEDGTLAKIAKKWFGEDVSK

SEQ ID NO: 4580 - protein, 470 aa, Bacillus licheniformis
MLKDYDFLKLIFQGIIDEIDIGLHVVDENGTSVVYNKKMSQIEGMDVGDVLGKNVLDVFTFASQHDSTLLQALHHGKTNKNVKQTYFNNKGQEITTVNHTFPIMENGNTKGAVEIAKDVTKLERLIRENMNKTESTKYTFDSLIGVSPAFKEVIEHAKRATRTSSSILIVGDTGTGKELFAQSIHNGSQRSTGPFISQNCAALPESLVEGLLFGTVKGAFTGAVDRPGLFEQADGGTLLLDEINSLDFRLQAKLLRAIQEKTIRRIGASKDTPIDVRIIATMNEDPVDAVSGQRLRKDLYYRLSVVTLFIPPLKDRKEDIMPLTQHFIDKYNALFQMEVKGFEEEVRRFLLSYDWPGNVRELEHLIEGAMNLMSYEDKIELTHLPLQYRTKPAAKEQLPQQGYDLFAPLPSASAAPLKEQIENAEKYYIQKTVKKCNYNVSQAARVLGISRQSLQYRLKKWKIRFDQESE

SEQ ID NO: 4581 - protein, 400 aa, Bacillus licheniformis
MTVLSKSEKIMKQTAHFGANNYHPLPIVISEAEGAWVKDPEGNRYMDMLSAYSAVNQGHRHPKIIQALKDQADKITLTSRAFHNDQLGPFYEKVASLTGKDMVLPMNTGAEAVESAVKAARRWAYDVKGVPDNQAEIIACEGNFHGRTMLAVSLSSEEEYKRGFGPMLPGIKLIPYGDLEALKQAITPNTAAFLIEPIQGEAGIVIPPEGFLKQAAEVCKERNVLFIADEIQSGLARTGKMFASDWEDVTPDMYILGKALGGGVFPISCIAANRDVLGVFNPGSHGSTFGGNPLACAVSIAALEVLEDERLAERSLELGEYFKEKLSQIDNPKIKEVRGRGLFIGVELTEAARPYCERLKEEGLLCKETHETVIRFAPPLVISHEDLDWAIEKITRVLSK

SEQ ID NO: 4582 - protein, 481 aa, Bacillus licheniformis
MNHENREQYTLKRTMKSRHLFMISLGGVIGTGFFLGTGYTINEAGPIGAILSYLAGGMIMYFTMLCLGELAVAMPVSGSFQTYATKFIGPATGFAVGWIYWLGWSVTVALEFLSAGQLMKRWFPDVGVWIWCLIFGLLLFSLNALSAKAFGESEFWLSGIKIIVILLFIILGGGAMFGLIDLKDGQAAPFFSNLIGDGIFPNGFGAIFITMITVNFAFQGTELIGIAAGESENPEKTVPRSIKQTVWRTLVFFGLSVFVLAGLIPWEKAGVVESPFVVVFEQIGIPYAADLMNFVILIALLSVANSGLYASTRMLYSLAKEGMAAQALSRVNKRGIPMNALWITLGFAGLSLISSVVAAETLYIWLLSLAGLSAQVGWITITVSQLLFRRRYVKEGGKVEDLKFKTPLYPYLPLTGFILNSAVLVSLAFDSEQRMALYCGILFMSACYFVYHVFVKKRQALDRQEAMIYQNKTNDEVVIDE

SEQ ID NO: 4583 - protein, 297 aa, Bacillus licheniformis
MNKQVSLIGMPMDLGQARRGVDMGPSAIRYAHIVERLNELGYDIDDLGDVPINRDQPKGDEGLKNLVSVLEGNRKLADIVDNVVEQRRFPLVLGGDHSIAIGTLAGVAKHYQQLGVIWYDAHGDLNTLETSPSGNIHGMPLAVSLGVGHEKLVNLHGYAPKIKPEHVVIIGARSLDEGERKYIRETGMKVYTMHEIDRLGMTKVMEETIEYLSANCDGIHLSLDLDGLDPSDAPGVGTPVVGGISYRESHLAMEMLYDADIITSAEFVEVNPILDHKNKTGEAAVELIESLLGKKLL

SEQ ID NO: 4584 - protein, 290 aa, Bacillus licheniformis
MDIRQLKYFVTIAREGKITTAAKRLHIAQPPLSRQLKQMEEELGVVLFDRNKKKNLTLTYEGEVFLKRAKEILHKLEDSILEVRELREEVNGTLAVGSTIYCAALLLSKVSKIRDMYPNLMFNIWEGEPSRLSELLESRQIDAAVTTTPIHSKNTESKSLPEVPCKLVLPGNQSYGLKGEAGMKEIAGLPLILLRPSHGKGIYDEVVHHFQSSGLEPRVVCECHDSTTLLSLVTSGFGATILPLSMLPAHFARHVQTLEIQNNPFILQPSVVWRAGSFLPKPVREFLALF

SEQ ID NO: 4585 - protein, 189 aa, Bacillus licheniformis
MNIIVGITGATGAVFGVRMLEWLKKTDAETHLVISPWAAATILHETGYTMKDVEKLASFTYSHKDQAARISSGSFQTDGMIVAPCSMKTLAGIRTGMADNLLTRSADVMLKERKKLVLLTRETPLNQIHLENMLELTKMGAVILPPMPAFYNHPQNLTEMVDHIVFRTLDQFGIHLSEAKRWEGMKQEK

SEQ ID NO: 4586 - protein, 473 aa, Bacillus licheniformis
MAYQDFRDFLNTLKKEGQLLEVQEEVKPEPDLGAAARAANNLGDKSPALLFNNIYGYNNAQIALNVIGSWPNHALMLGLPKDTPVKEQFFEFARRYNQFPVKVQREETAPFHENEITEDINLFDILPLFRINQGDGGFYLDKACVISRDVEDPDHFGKQNVGMYRLQVKGKDRLGIQPVPQHDIAIHLRQAEERGENLPVTIALGCEPVIATAASTPLLYDQSEYEMAGALQGEPYKIVKSKLSNLDIPWGAEVVLEGEILAGEREYEGPFGEFTGHYSGGRSMPIIKIKRVCHRNNPIFEHLYLGMPWTEVDYMVGINTCVPLYQQLKEAYPNEIVAVNAMYTHGLIAIVSTKSRYGGFAKAVGMRALTTPHGLGYCKMVILVDEDVDPFNLPQVMWAISTKMHPKHDAVIIPDLSVLALDPGSEPAGITHKMILDATTPAAPETRGHYSQPLDSPIGTKEWEAKLMNLLNQ

SEQ ID NO: 4587 - protein, 151 aa, Bacillus licheniformis
MAQLSNELFQLLNGEKLAGKRHEAMMLQTVTEDGWPHTAMISAGEILALNKTDIRLALWQGTTTTANIARTGRALFVACWKGKAHYVRLSLKKLPELRDAKHPRARFAGTVEAAREDIAKYADIISGVQIKLKDEAAVLRRWEETLGELRK

SEQ ID NO: 4588 - protein, 148 aa, Bacillus licheniformis
MSNFLQKPRNKAILSVYLFFVCGSVLSAVLNPKMSIGEKLFILCFNIFSATLFAFLIYLLLNKLMKDEDRKHPADPEKNGINQVIWKKYKKPLILFVYFGSLFAVCAAILPMPIYTVAEKLVILSIAIIFITICCILAYKVTNKMLQK

SEQ ID NO: 4589 - protein, 113 aa, Bacillus licheniformis
MSPETFVEYTEYLIAGMLAAHFAYSLCFLIIASHMIIEYEKMIFLKPEKRSHKITNTFVFLLVGTGYFVYKRLLRYNWFLRKLYFALYLVGRGILSIIIFYIFSFLVHLIFSV

SEQ ID NO: 4590 - protein, 148 aa, Bacillus licheniformis
MKGRNKIIFLVYSLYATIIILAALVKPAINWKERLAVIGFMFVSISLFTFIIYVFINKPKKDQSAPRCNIVAKIFWKKHRKPFTLSFYFVGILIVGISVFSMSELSLAWKSGMFAILFAVISGNFFAVYQTANQMLNRSCLERMPDEE

SEQ ID NO: 4591 - protein, 226 aa, Bacillus licheniformis
MLRLKETVVYKDLPYNIQSHLKAPVSRETKWGMACFIVLVLDILCILPVLASKVEFFTFAVLPVAILINVWMILINTRNMTEYLHHLQYVRFMGVSFSGMSYCQLITAQKMMFSAIGFHLPLISLSLFIYAASIFLVIRYYLAVFPDPKRGKRETAAPTGMLLAAVPAAGYMISHAVLRVSESAVYLLMSIVYLLMACLFSIMGVKFIHKYFFIKANQDIIRQHRI

SEQ ID NO: 4592 - protein, 267 aa, Bacillus licheniformis
MKHLITCTSEELALLVGLCDYPGVAKGILESSLGKKSKKEWDAILEATVNQLILKQYWDEEKSSKDENPLSEEMQKFIVSYVNSEQMIRCSNLDNKNTLMLHHFENETWLFHMIDRDIIHEFAYVDEQEIAQLMKDYYHFSTDEEHIPLKFRLSDKCFDWLSNKDMTEKVRKKSSFSPEEEHSFNQLIADLEANQWSLNNISHFYIPSLNDGPFLQNIVFFIPSARGVWVAQYDEHNEKPVHISLRTLEQWNELLKGLEYTVSFQNT

SEQ ID NO: 4593 - protein, 113 aa, Bacillus licheniformis
MTPKVFVEYAEYLIAAILSSQFVFGLCTLFLGYITMNYYEQGTFRPPSNIFKKTVNFGFALIFGASYFTYKRLYRYNLFLRKFYYALYLLGSGILSIIIFYILSFILHFIFKV

SEQ ID NO: 4594 - protein, 541 aa, Bacillus licheniformis
MKTLDVQAFQTGLDKTLTELKNQTDEISKVKQSIKGLTSLDDALKGAGGEAIRSFYEECHTTFLLFYESFISDYKGLLEKTKSALHSLEPNQNGFISQSFLENELHDGVSQAESLTGRLTSKANQTMATVSHIVDLPDLDDSAVNENAKKAQRQISETLEKLHTFDREQTNALKAAREDLDTMKQYIQQLEKMYTGPKIEISEYKSGSILKPQNDSTISQAPGGLQNDLQNPGETPMEKMLGRLEEKAAETLTNPDTQDKEKTNIAHEILSYFETFGEPLDVGDKALLGYHAANATASIAWTRKLKIYYQGGKPTKWQRFKGEYKFQVMSHRSWTSQGDHSSKVARTIKNISDSNPSNPLLKKAQKFVASYDSPSMMFKHAVGFPKNQHSFIDGKEFRKRAALRTKAGAVDIMESTAKAKGFTALERGVPIVGTAVTFASNLTEYTDPENSDKSFAEKTGRFAAGVGTDIFAVSTGVEIGATIGSVGGPVGVIVGGAIGGVAGAIASSSYGDAIKDAGEKVAGSIEKGIKNSFESVKSWFK

SEQ ID NO: 4595 - protein, 95 aa, Bacillus licheniformis
MITMGQEIKVKTGEVKQALSKLKHSAQAVKPNVQTDISGKNNLDVVKKIESMNKDLKSLTKAYASALAKQIAQTEQAVNAIKDADKKLSSSIKAK

SEQ ID NO: 4596 - protein, 127 aa, Bacillus licheniformis
MIWEKTVLYGLQGTLLIKKQQLEQLKNCQTELEADKKEFDDSKDSIKKPELSPTTWQGSLADSFKNVRSDMKTAYNDICGKQLNEVFKQLKEKISSLNDDIDSLGKDISSLKTKIEKLEKEEREARR

SEQ ID NO: 4597 - protein, 330 aa, Bacillus licheniformis
MKKLLVVYAVMLCLFFLYVYDYSRGDKAGSAEESRRPAAAGSLSEKYVMVTFQSGIEYWKSGLKGFEDAAQLFNVSVEYRGAAHYDVHEQTTVLEQVIAKKPAGIAVSAINPKALNPVIDKAHEQGIPIVLFDSDAPLSKASTYIGTNNMEAGAVAARRMAEFLNGKGETAVITQPQQYNHQERTKGFEQTIKQKYPNMKVAAVLDGKGDELTSKKEAAKILEENPSIKGIFTTEANGASGVARAVKEAGLEGEVCIIGFDKDKKTLDGIKNGSISATMSQDTWQMGYWSLHMLFFSNHHLKHERPLPAAIDTGITIITKENVAAYYAND

SEQ ID NO: 4598 - protein, 589 aa, Bacillus licheniformis
MRMIKRLINNAPIRHKLISLLLLISMLPTIGLGILSGWAVENIIEKQVIDQTLQLIGEVNKTAEVYVSHMQNLTYLISMNEEMEAFFSHKKEDGEADYKRRTFLQGLTSLYSEAAGILVVNDKGEMISNEMYERTPTDLTKEPWYQAALDNEGIFKMIGKPVNRNIRSHVHYREDEVVSAVRAVIDPETQHVKGVVLIDLKLRVLAEATKNIRLGKTGYLMIMDENGGNIYSPETSNLFLPKKWFRQERSGYFSKRIKGEEYQFIYETSSFTNWTTVGVFKAGEPVFEVKEIHLYVLLFLLTAAFLGMSASYYLSHSMSRPILKLNAVMKTAESGNFSTLYQEEREDEIGLLGKSFNRLMFRIRELMSVTERQERQKREAELRALQAQINPHFLYNTLDTINWMARKKGAEEVSDLVQALSKLFRISLSKGKDIIPLSDEFEHVENYLKIQKARYRDKLNYSIEMTGLCDDRLILKLVLQPIVENAIYHGIKEKKGPGHIAIKGMEEDGSLIIKIEDDGAGMDEETLKQITDQFKHRDDTAGYGMINVHERIALTFGEPYGITVESRKGAGTAVTIRLPILAKGGTSLE

SEQ ID NO: 4599 - protein, 400 aa, Bacillus licheniformis
MSECWRVLIADDEPWIREGIRDAVSWERYQMSVSAEAENGEEAFELALKHGIDLLIVDLNMPIVNGIALMKKLRGALPQCRFVIVTGYDQFAYAQEAIRLNVDDYLLKPVDPAHLEQVLKKISVSLAAEKKKLSEQKLAEQHIQQNLGLLKEHVFRSWIENRADEEDVYRQLECLRLPARNPETLGVIAAGHVWNKPSEADNLKEKVERFFINERDKAVFFDGDRLIAACLWRSVTEAEQRALAEMIKAELQASAAVCFAKLAENGRSAPQCYQHCRQQVSKAFNISPVVIRAKEYMQKHFTEREFSLIQMADALQVSSVYLSRMMKKELGVTFVQLLTEMRMDQAVHLLETTPLSIHDIAEQTGYDTQHYFSTVFKKTMGVSPNQYRRMSGIERTGGKL

SEQ ID NO: 4600 - protein, 359 aa, Bacillus licheniformis
MKKCWLLITAMLFCLIVTACSGNQASGGGDKGYVGISMPTKSSERWVYDGKYMVKEFEKLGYKTDLQYAEDVVENQVSQIENMITKGVNVLVIASIDGEALTDVLEKANKQDIKVISYDRLLMNSKHVDYYATFDNHKVGELQGKYIEEKLGLKDKKGPFNIELFAGSPDDNNAHFFFDGAMSVLKPYIDSGKLKVLSGQTSFEQGATLRWDGATAQSRMDNLLSAHYTKAKLDAVLSPYDGISIGIISSLKGAGYGSDKKPLPVITGQDAELASVNSIIKGEQTSTIFKDTRELAKKAVEMASSVLKGEKAEVNDTKTYDNGEKVVPSYLLEPVVVDKENYKKVLVDGGYYKESELGK

SEQ ID NO: 4601 - protein, 522 aa, Bacillus licheniformis
MSDCILEMRGITKEFPGVKALDNVHLRVKAGEIHALCGENGAGKSTLMKVLSGVYPYGAYTGDILYKGEVCQFKNIKQSEEAGIVIIHQELALVPQLSIAENLFLGNEQASRGVINWRKTKLETLELMKKVGLQESPDTLVSQIGVGKQQLVEIAKALAKKVQLLILDEPTAALNEADSENLLQLLLELKKQGISSIMISHKLNEVTKVADSITVLRDGQTIETLDVQSGQLTENRIIRGMVGRELQNRYPDRSAEIGDVIFEVKDWTVHHPLQQDRKVVNMAAFSVKRGEIAGIAGLMGSGRTELAMSIFGRSYGKNISGTIEKDGRELYINHPEDAIKNGIVYVTEDRKGNGLILKDSIKENITLSKLDKVSSRLVMDERREQHEAEDFRRKLNIKTPDISQRTGNLSGGNQQKVMLSKWIFAEPDVLILDEPTRGIDVGAKYEIYGVINQLAEAGKAVIMISSELPELLGMCDRIYTMCEGEITAEFSKEEADQEKLMKYMTIRMKRGGEAYADTGANG

SEQ ID NO: 4602 - protein, 403 aa, Bacillus licheniformis
MQTPVQTDKDRAQPGYFQLFRDMYKQNIRKYSMVIALVFIMLLFQILTDGILLRPLNITNLILQNSYILILAIGMMLVIITGHIDLSVGSVAAFVGAVSAMMIIENDMPLFAAVVLSLLLGAAIGAWQGFWIAYVKIPAFIVTLAGMLLFRGLTMIVLEGKSIAPFPVSFQKMASGFIPDWLNGGTFHLTTIVAGAGVSILYLVYQLQQRNMQKKFQFDLQGKGLFTVKVFFIIAIINLFTYILATYEGIPLILITLFVLIAGYTFVMKKTVIGRRIYAIGGNEKAAELSGIKTKRLTFMVFVNMGVLAALSGLIFAARLNAATPKAGNLFELDAIAACFIGGASAYGGIGTIGGAIIGGLVMGVMNNGMSLLGLGIDWQQAIKGLVLLIAVAFDIYNKNKTS

SEQ ID NO: 4603 - protein, 422 aa, Bacillus licheniformis
MKRKIHYAWIIVFVTFLTLLAVQGVRLSFGAFIQPWEEEFSMDRGTISLISMLSFIVYGVSQPVIGRLVDRFGPRIILSLSTLLVGLSIFFTYLVTSPWQLFILYGIIVSLGVGGASNVASTVIVTNWFNEKRGLAFGIMEAGFGAGQMLLVPGSLMMIHWFNWKVTVIVLGLFLAVIVFPIVILLLRNHPSEKNVQPIGGAQGGEIKEEPDAQPKKIPYKAVFLKRTFWFLVLPFFICGFTTTGLMDTHLIPFSHDHGFSTEVTSAAVSLLAGFNIIGILISGVVADRWSSRKILCFLYAVRALSLVILLSSHNSMLLLCFAVLFGLVDFATVAPTQMLATQYFRQYSVGFILGWLFLSHQIGSALGAYLPGVWYSQTGNYNLSFYLSIVILAVASILNILLPEPKKINPTLNQEGRSVQQ

SEQ ID NO: 4604 - protein, 305 aa, Bacillus licheniformis
MAEINHSTTLKFRKFNRFYTNVLGFLNEHIYDSPFSLTETRILFEIHNTADCTAKLIQDTLGLDRGYVSRILKRFEKENMVYKKRSEEDSRNHYIYLTSFGESIYKKLEAKANQQIENMLKHIDGRHQEKLTEAMNTIECILSEHLPPEKSAVSIRDYYISDDIKLMIEKQRAFYAETHGWDDSFLDYLHETFDAEIEKIWIAESAGRFAGCVGLVKHPGRTVQLRWFLVDAAFRHQGVGTRLLEHLIDYCKENQYERIFLWTVSTMAEARPLYEKFGFRLTEVKDETLLWGQRLREERWDAELG

SEQ ID NO: 4605 - protein, 690 aa, Bacillus licheniformis
MVKPYPPISRKVPRLLHGADYNPDQWLKYPDVLKEDIRLMKLSRCNVMSVGIFSWVSLEPEEGRFTFDWFDQVLDTFKENGIYAFLATPSGARPAWMSKKYPEVLRTERNRVRNLHGKRHNHCYTSPVYRRKTAIINGKLAERYAHHPAVIGWHISNEYGGECHCELCQDKFREWLLAKFKTLDRLNDAWWTSFWSHTYTDWDEIESPAPHGEDAVHGLNLDWKRFVTDQTVDFCRHEIAHVRSFNPDLPVTTNFMGTYAGLNYWKFADLLDVISWDSYPAWHNSRQEDSRLGADIAFVHDINRSLKGGRPFMLMESTPSMTNWQDVSKLKRPGMHELSSLQAVAHGSDTVQYFQWRKSRGSSEKFHGAVVDHEGSEHTRVFQEVKKLGEKLEKLEDVAGTTVEPEAAIIFDWENRWALEDAQGPRNIGKHYERTAKSFYEPFWREGVPVDVIHMEADFSRYKLLVAPMLYMLREGTAERIEQFVQNGGTFVATYWSGIVDENELTFLGGFPGGLRKTLGIWSEEIDALHDGQKNTIVMDEENRLGLSGSYEASELCDLIHLEGAEALAAYEDDFYAGRPALTVNLFGDGKAYYIASRNEAAFQEAFISRLIEECGIAKVLDTELPKGVTAQLRTDGRHDYIFVMNFTAENRSVSLPEETNTDVLKGTRKKGALKLPPYGTSILRRSHKA

SEQ ID NO: 4606 - protein, 375 aa, Bacillus licheniformis
MNFYKTLALSTLAASLLSPSWSILPRAEASAYKDFSVTADAETEPVDTPDDAADDPAIWVHPKQPEKSRLITTNKKSGLIVYDLNGKQLAAYPFGKLNNVDLRYNFPLDGKKIDIAGASNRSDGKNTVEIYAFDGEKNKLKNIVNPQKPIQTDIEEVYGFSLYHSQKTGKFYAMVTGKNGEFEQYELFDNGKGQVEGKKVRSFKMSSQTEGLAADDEYGKMYIAEEDAAIWSFSAEPNGGDKGKIVDRAGGPHLTADIEGLTIYYGEDGEGYLIASSQGDNRYAIYDRRGKNDYVADFSIDDGKEIDGTSDTDGIDVIGFGLGKKYPYGIFVAQDAKIRKMDSQPIRTSKLSPGKKLLTRWTTSLISMIRSIPEN

SEQ ID NO: 4607 - protein, 496 aa, Bacillus licheniformis
MSNHQKETFQNIPQKGFFGHPRGLFTLFFTEFWERFSYYGMRAILIYYLYTEVTKGGLGFDQTTANSIMAVYGSLVYMSGIIGGWIADRLLGTANTVFYGGVLIMFGHILLSFPGSVPAFFISMFLIIIGTGLLKPNVSSVVGDLYSPEDTRRDSGFSIFYMGINLGGFLAPIIVGTVGQTYNYHLGFSLAAIGMLFGLLTYLATRKKNLGSAGRTVPNPLTPAERKMVFGRIGIGVLVIAAIFGYSIFMGWMTIKLFTMIVSCLGILIPLIYFIVMFKSSKTTSDERSRLTAYIPLFVASMMFWAIQEQGANILATYADKRTHLEFLGVQLHSSWFQSLNPLFIVVLAPVFAWIWMRLGNRQPSTPTKFSLGLILAGLSFVVMIFPAYINGTESLANPMWLVLSFLIVVLGELCLSPVGLSATSKLAPAAFSAQTMSLWFLSNASAQAINAQIVRFYSVDTEIAYFGIIGGVSILLGIILMLLSPKIQKFMKGVN

SEQ ID NO: 4608 - protein, 585 aa, Bacillus licheniformis
MQQQPDEMRMTVVDATKFGAVGDGKTDSTNAINECLAWTKSMGYNTVWIPNGTYMIDGTKNGDPRAPFRGAGINVPGNIEILMDAEAVIKVKPNSSWGYAAFYIGGTSDIKISGGSIIGERDEHTYTPAPRPTHEWGFGICIEGASNVVIEHVRIADFTGDGIIISNGGEGYRPSERIQVTNCDIRRSRRNNLSITGCDNVLVEGCEIADAGTGNGTAPCFGIDIEGYSEGSIVYEEPVNVIIRNNVLKGNVNHAVSNFNGTSVIIEGNVADGTISYGYGTGTTIANNIIKKNPEFTGQSTGINGLGVGALEERSDAVIKGNLISGFTTGIDIRGKSVFATGNKIRDFVNAGILAYQASQVFIEGNYIENDVPEQRSGTAFSITQSDNVTCSGNHIANVVLAVRSTGNDVQIKHNVIKQFSRGIWISQGNAVIEGNFISPNGFQTVPESYAVSVTNTASAVIQQNTITRFRNFPIYCSTNQHTKIIGNYIEDSPLIVTVFLTRGTHEVIGNTITLSRPSLPAVLIYLDQSSDSAILNNTLRSNTEARVTAIQTNTSRQTLIIGNTIVKGMIHSHQTDTVNGNIEV

SEQ ID NO: 4609 - protein, 72 aa, Bacillus licheniformis
MKLIGIGLLLLASLEAFAVMLDVFQGMTLQRAIVNSLTFAILEVGEWIIILLFLFIIFLEASESFRKKRKRT

SEQ ID NO: 4610 - protein, 529 aa, Bacillus licheniformis
MSGDKNPETVKLSGFVRPLLAENLSLIKEMTGNSSDIVIRKLKTGAGEKIEIAVVYVGGITDEKAIHDFLLESIMNSEELAEKEYGREVLETIAGDAVALGGVEKEKRLDKVLESLMAGNTIILAEETAEAVITTTKGGEKRSIKEPENQQAFRGSREGFIEALDTNISLVRRIIKNPNLWVEKTTMGSVTKTDVAIMYINGICDPKAVKEVKKRMESIEIDSILESGYIEQFIEDTVFTTFPTVYHTERPDMVAGNLLEGRIAIFVDGTPFVLLVPAVFIQFFQSVEDYYSRFDIATFIRFLRVLIFFISLIAPAVYVGATTFHKEMIPTELLVVIAAQREIVPFPAVVEAMIMEISFEILREAGIRLPKAIGSAVSIVGAIVIGQAAVQAGIVSPAMVIIVAITAISSFATPSFSMAISARLVRFFFILAAATTGFYGIILGLIIMFVHLCSLRSFGVPYMTPFAPFILKNWGDAIVRLPWWTHEKRPELIGNDNKVRQGEYQKPEPPDSGDMKTKQEDGDPNETNR

SEQ ID NO: 4611 - protein, 407 aa, Bacillus licheniformis
MKRIVKIVLLLAAIVLLQGCWDKRELTDLLLITAIGIDKGKDTDYELSYQIVNPINVTGGLQGGQGGDRPPISSYSVTGNNLTEMSRHASAKMSREIYYSHTNLVVVDEKLAKEEGLIKILDVLDRDTDFRTTATIIISRGQKAKTFIRTLTPIDKIPSNKVNKTLQFTEEHLGEHMKTSVQDVIKCLTSKAKHPIISSFKVTGNKEKGEKMENVQSTSPEAIVEADGLAVIKEGKLVNWLEGKTARGVLWLRNKISRTYLTIPMNHERDAVTFDVIRQKTKIGSHLKNGKPAISVDVAMEGDIGETTVPIHLDDPKVLSDIERKVAKELKNELQNTIDIVKRNKTDVLQFGDVVYRTHPEVWKKMEGEWSNRYFPDTDVDITVNAYVRRTGLRNNPNILNHHEGRS

SEQ ID NO: 4612 - protein, 368 aa, Bacillus licheniformis
MEKAKISAAQLFVLIVLFELSSSLLIFPGQSAEQDAWIAILFGTVGGLALFMMHHFFYQVNPDASPYETLMNIFGKPVGWSMTFIYIVYYCYIAARVLRDFGEMLLTSAYPNTPIIFANGLLIAVCIFTVRKGIEVLARSGELLFGIMFWLAVTGLILIVSSGLIKPKELLPILGNGPGPMFHAVFTQTLYFPFGEIIAFTLILPYLKEKKLAKKAGLLGIAISGLILAFNVALNISVLGVDLNMRSRFPLLSTIQTIQVAEFLDRLDVFFMLVLVIGGFFKMSIFMYAVTEGVTVLFKLKNPSKVVHVIGIIILILSVSIASNISEHVKEGIEFVPLYVHLPMQVILPAFICIVTYVKMKKNKKKAM

SEQ ID NO: 4613 - protein, 242 aa, Bacillus licheniformis
MLYTVKEVARLANITIKTLYHYHKIGLLCPAEVTDAGYRLYGVKELERLQHILFYRELEFPLKAIKQILDGKADRLTILSEQKRLFTARLDRIKQLISTIDLSIQQAGKGEAMDQSSMFKGFSSSREWEDALAEQNRYLKEAYDVDLLKGEPVIAEEMNEKAEEAARFMNGMAEALRDGVKHDHEQVKTAIKRHLKFLGITPDDFQSQTRFFIEDDFHRGMLENQQTGLSYYLAAAAEAFAS

SEQ ID NO: 4614 - protein, 227 aa, Bacillus licheniformis
MGSILEFQNVGYWYKNQDQPLFEDISIQFSQGLLYTIVGTSGSGKTTFLSLAGGLDAPKEGNILYKGENISKIGLTSFRNQYVSIVFQSYNLLPYMTALQNITSAMEITGSQVKNKEQYALEMLEKVGIGEKQARQKVLTLSGGQQQRVSIIRAFCCDTDLIVADEPTGNLDEDTSKDIVRLFQNLAHQENKCVIMVTHDEQIAKVSDVNITLSRGGFTVKKRISAG

SEQ ID NO: 4615 - protein, 479 aa, Bacillus licheniformis
MNFFKRAFWSMKAKKGKTLLQLFVFTMICVLVLTGITIQSAAVKSSELAREQLGGSVTLKVDREKMMKEQQDSGDRKRFESTPVSLKSAEKLASLYHVKSYNFISSTSALADNFDPIESGDEDSTDSNSDQPAGSGGNEQGGRQMMQADVSIEGVTSTALVDEFADGTSKITEGRALTKDDVNEKVAVIEETLAEENELKVGDTIKVKASSDEDATINLKIVGIYKTTSSGDNQAQNFAFLNPYNKIYTPYTAASALKGDDYQNAIDEAVYNMDDASNIDAFIAAAKKTGIDLDTFTLDANDQLYQQMVGPIENVASFSKNVVYLVTVAGAVILGLIVMMSIRERKYEMGVLMAIGEKRRKLIGQFLTEILMIAVLAIGISALTGSLIAKQIGNQLLSQQIEQTSASQSAGGMMGPGGGGFFGQSTAQVSAIDQLDIQVSFGNLMALGGIGLLIAMFATLLPSISVLRLHPKTILTKQE

SEQ ID NO: 4616 - protein, 228 aa, Bacillus licheniformis
MKILMIEDNLSVCTMTEMFFAKEGFETEFVHDGLEGYNRFKSGDWDLLIIDIMLPSMDGVTICKKVREESTVPIIMLTAKDTESDQVLGFELGADDYVTKPFSPLALVARIKAVSRRYQNAGRQDSADSDTLETEHFKINKKTREVFLDGVQIQNLTPKEFDLLYYLVQSPKQVFSREQLLEQVWGYQFYGDERTVDVHIKRLRKKLGSDSRPFLYTVWGVGYKFDED

SEQ ID NO: 4617 - protein, 475 aa, Bacillus licheniformis
MKIKYLYQLLASHISILVLAFLITGALFSHFAKDFAYESKVDELSSYGYRIMGEMEMRPKGAPAIMKPFEEILRSRKISFFLFNEKKEILMTPADLRPRKLLLSDEEWKELKDGKAVVVKTDFNRFNEEVSVVALPNIVNNEFQGGILLTAPISGTEEMISDMNRFMLFTAAGVILVAILLSWLTSKFHVARIQKLRDATKKVAAGDYDIHIENRNKDEIGDLGDDFNIMARKLKSSSEEIDRLEKRRRQFITDVSHELKTPLTTISGLVEGMNSQTIPEDQQDKCMKLITEETKRLIRLVNENLDYEKIRSNQITLQKLHYPLIEVFEIIKEQLALQAEERQNQLILDVEDHVMVNADYDRLIQILVNITKNSIQFTTNGTVWLRGREDYKETVIEVEDTGIGIDENDIENIWDRFYKADLSRTNTPYGEYGLGLSIVRQLVSLHNGTVEIESEKNKGTKFIIRLPLTARDDDE

SEQ ID NO: 4618 - protein, 572 aa, Bacillus licheniformis
MNLLRNIKIRSKLFVIIIISALALSIVGIQGVGGLSKLSKGSEMIYQDQLIPNQLFARLKANNLDLDTYKFELMVTKDSDRNETLQKNIKEKNEENNTLMEKIDQLKLMDNVSEKYESFKSEYKKLQDISSQMLSLAVKNENDKAYDVYLKEMEPQRETVNQLIEDIQTLNADNAKTIYQRDSKEAGSIITLLIIVIAASLVLSISIGLLMTRLITKPIKDIQALFAETEQGDFTVKGTYQSKDELGLLTASFNKMVAGVRSIIETVGETSHQVASSSQELSASADESTKASEYISTTIQELAVGSDQQVESVENSRTVIKGMTEFAGRISSSAEKAAATADQTAKMSLEGTKAIDKVSAQMQSINETVVSLSEAFKHLTERSNEIGNITEVITSIAEQTNLLALNAAIEAARAGEQGKGFAVVADEVRKLAEQSAQSAEQITRLITIIQNDTKQTMNSVISATGEVKEGLVVVHEAGGAFQKIENSITEVVTQINDVTNLVKNLTAGTSEIETAISGVKEVAETAAGSTQTVSAATQEQLASMEEIAAASQILAQNAEELQHLIQKFKIKD

SEQ ID NO: 4619 - protein, 453 aa, Bacillus licheniformis
MKVVKFGGSSLASGAQLEKVFQIVTSDPERRAVVVSAPGKRHPEDTKVTDLLIECAQQYLLSKEATGLVEAIVGRYADIALELGLADDVINRIRADLLQLLEGDKTNPERFIDAIKASGEDNNAKLVAAYFRHRGVEAHYVSPKDAGLFVTSEPGNAQVLPESYDNLFQLRQQKGIIIFPGFFGFSQEGEVMTFSRSGSDITGSILANGLKAELYENFTDVDAVYSVNPAIVSNPKEIRELTYREMRELSYAGFSVFHDEALIPAFRARIPVQIKNTNNPDAEGTRVVATRDNTNGPVVGIAGDSGFCSIYISKYLMNREIGFGRRVLQILEDEGLTYEHIPSGIDDITIILRQNQMDQAAEKRMIKRIKEELDADEVAIEHNIALIMVVGEAMRHNVGTTARASKALSEAGVNIEMINQGSSEVSMMFGVKEAQEKQAVRALYQEFFAKVLV

SEQ ID NO: 4620 - protein, 317 aa, Bacillus licheniformis
MKLRYLLLMLIILSFSSIFIGVKELSPLDLFRFNEDEIQTLYISRIPRLISIVLAGMSLSICGLIMQQLTRNKFVSPTTAGTMDWARLGVIIAIVLFSSAGIVVKILFAFVFALFGSFLFVKILDRIKFKDAIFIPLVGMMLGSVVSAISTFMAYQYNIIQNVNAWFEGNFSLVMKGRYELLFLSIPLVIIAYLFANKFTLAGMGESFSINLGLKYKRVVNIGLIIVSIISSVVILTIGTLPFLGLIIPNIVSIYRGDHLKNSLPHTAVLGAVFVLFCDIAGRLVIYPYEISVGLMVGIIGSGVFLYLLLRRKAYAS

SEQ ID NO: 4621 - protein, 314 aa, Bacillus licheniformis
MRHKQKMLVLIVIAAVCIGLFLFYGLPSVWEYALPRRFAKVFAIIIVGTAIAYSSMIFQTITNNRILTPSILGLDSLYVLLQTGIIFFFGAAKLADLGKNGNFLLSTGLMVCFSFVLFFLMFRRGGRHIFLLLLVGIVFGTLFRSLSSFMQMLIDPNEFQVVQNKMFASFNNLNTDILVLASLVILAILVYAWRFNPYFDVISLGRDQAVNLGIDYDRTVKKMLIVVAVLVSVSTALVGPITFLGLLVVNVAREVFKTYKHSVLIPGAVLFSIIALVGGQFIVEKLFGLTVTLVVIIDFIGGIYFIYLLLKERK

SEQ ID NO: 4622 - protein, 252 aa, Bacillus licheniformis
MIEVRDIMKQFGEQTVVHPTTLTIQKGMITSFIGPNGAGKSTLLSIISRLIGMDAGKVLIDGKEIGAYKSNDLAKKISILKQSNQINIRLTVRELVSFGRFPYSQGRLSKEDWAYVDEAIDYMKLRDIEHKHLDQLSGGQCQRAFIAMVIAQDTDYILLDEPLNNLDMKHSVEIMKLLKDLVENRGKTIVIVIHDINFASVYSDRIAALKNGRIVKEGPAEDIIQTPVLKDIYDMDIPIQQIGDQKICVYFK

SEQ ID NO: 4623 - protein, 315 aa, Bacillus licheniformis
MKKLSLLIMALITVLVVAACGNKAADTDAKSSSKKETVTIKHNSDTTDVPKNPKKVVVFNFGMLDTLDELGLSDRVVGLPKQTLPSYLKKYKDSKFESVGGLKEPDFEKIAELEPDLIIIEGRQSEQYDEFKKIAPTIDIELDQKNYMNSFKENTENIGKIFGKEDAVKEALAKIDEKVEKANKLAKEKGGKGLVVLTSDKQISAYGSGSRFGLIHDVLGVEPVDKNIEVSLHGQSVSSEYISEKNPDYLFVIDRSAAIGEKGTAKEVIENEIVKSTKAYKNGHITYLDPGYWYLSGGGLESVSEMVKEVENGLK

SEQ ID NO: 4624 - protein, 473 aa, Bacillus licheniformis
MSTGTEQQTYNRNIIVGLLIAGAFIAILNQTLLVTALPHIMADLNIDATKAQWLTTAFMLTNGILIPITAFLIEKFSSRALVIAAMSIFAAGTVVGAVAPNFPVLLAARIIQAAGAGIMMPLMQTIFLTIFPVEKRGAAMGMVGLVIAFAPAIGPTLSGWIVDSFTWRYLFYIILPIALIDLVLVILLMKNVTKLRETSVDIISIILSSLGFGGLLYGFSNAGSEGWGSNTVLISFAVGAVALFFFISRQLKIKRPILEFRVFQSWTFTITTLLGMIVFALMIGTETILPLYTQNVRDVTAFDSGLMLLPGAIAMGIMSPIIGRIFDKIGGKGLAIIGFAVLLLTSIPFADLQMDTSLTFIIVIYTLRMMGTSMIMMPLTTAGINALPAHLIPHGTAMNNTMRQIGGSIGTAVLISVMSNSAKNAATSHPLNALIHGMNSAFIVAAVLALIGFILSFTLKKKPQADKQGQPAR

SEQ ID NO: 4625 - protein, 306 aa, Bacillus licheniformis
MSFIIAKEGAGMNEKKAAVLRAAKKLFAQKGYHNVAMQAIAEECKMSKASIYKLFQSKEDLLLALIKFRKHEMLNKSAVINTETSLTPKERFAKKIALEITEFRENRQFINFISNEGSSPDTAVFKKHLKETKSMIISWHKDSIIQAYGEEVEPFIWDIVIIFHGLMREFLFLVGTGKAQPDVKTIPPFIMSVLDLFIEKKLNEDQKSSLNEDIIASYSNFSSCWAPPKKEELLEDLLQKLKTKISSLPQDDVSVTELLSAADLLSEELFANEPRTYLIKALLDYLGKIEAIQYDVSQIQTISIKE

SEQ ID NO: 4626 - protein, 280 aa, Bacillus licheniformis
MKSFAKYQTFLDLHHQSDPFVLPNAWDAASAKAFQNCGFKAVGTTSAGIAMSLGYPDGEHLPFETLLSVLKTITDAVDIPVSADLEAGYGQTPETVAENAKKAAAAGVVGMNIEDGTKDPCRPLSDATLMEEKITAVKKLNLPVLINARTDVYWLNADAPGSRLQAAVRRANRYSQAGADCIFIPGADDAGTIAGLRKGISGPINVLAGSHTPSLQILSELGIERISCGSAPFRAALSLVKKIGEDIIRRGAFNRMTDGVLSYGEAADWISLHRDPKQNR

SEQ ID NO: 4627 - protein, 245 aa, Bacillus licheniformis
MNEVLKTLKDHRSIRSYTDEPVSPEQLDDIIQAVQAAPNSINGQQVTVITVQDEERKKKIAELAGGQVWIEQAPVFLLFCADFNRAKIALEKNGETLAITDGMESVLVGAVDAGIALGTATAAAESMGLGTVPIGAVRGRAEELIKLLNIPEYVFPVAGLVVGHPADRSAKKPRLPEQAVRHSETYQPDLKPLIDAYDEEISEYMTKRTNGQETRNWSQGISAYYNKVYYPHIREMLEKQGFKLE

SEQ ID NO: 4628 - protein, 95 aa, Bacillus licheniformis
MIVLQAYMKVKPEKRDAFLESVQPLLKHSRAEAGNAQYQLFEDTEHANTFVMLEQWKDQDALDAHNQTEHFQAFVQAAGDLLSEPLNVVKTHTTD

SEQ ID NO: 4629 - protein, 98 aa, Bacillus licheniformis
MKTNEMKLTAVLQALSDPYRLEIVKALADTAEKTCGTCTNLNIAKSTLSHHFKVLREAGLLKVRIEGKHHYYSLCKRELEEQFPGLIEAVLKVEKERW

SEQ ID NO: 4630 - protein, 476 aa, Bacillus licheniformis
MITIPIDRSKGAEYIYHQIYQRIKEEIFSRNLLPGKKLPSKRELAETLNVSINSVNAAYQQLLAEGYLYSRERKGFFVEQIETFHASRHPGPLQLEKELVEEPESKDGWISFSHMSVDTAHFPFKTWLRCEQKAVSSHVDELGEMTHPQGVYEVRQTIARFIALTRGVKCLPEQIVISAGTQSLIHTLQDLLPASAVYAMEEPGYSRIYRLLKNEGKEVATIQLDHKGMRISEIHRLNPDVLFVTPSHQFPTGIIMPVSRRIQLLNWVSDGANRYIVEDDYDSEFKYGSDTIPALQSLDRSEKVIYIGTFSKSLLPGLRISYMVLPQKLLKRYRKRHHFSIQSSSVLTQLALQELIESGEYQKHIKKMNQIYEKKRTRLIGSLVKHFNGRVKIKGESAGLHFVADFETDRSEEEVLLRAKERRVEVYGMSRFTLKKEQTKHEGTVSLVLGFAKIAADQIDEGTAKLYEAVCGDEKL

SEQ ID NO: 4631 - protein, 437 aa, Bacillus licheniformis
MSRNTKAFTTEDWQAKRDQFVARGVSNGNRHLAAKGEGAVLYDIDGRRFIDFAGAIGTLNVGHSHPKVVEAVKRQAEQLIHPGFNVMMYPAYLELAEKLCRLAPGAHEKKAIFLNSGAEAVENAVKIARKYTKRQAVVSFTRGFHGRTNMTMSMTSKVKPYKFGFGPFAPEVYQAPFPYYYRKPEGMTDESYDDMVIQAFDDFFVSSVAPETVACVVMEPVQGEGGFIIPSKRFVQHVAAFCQKHGIVFVADEIQTGFARTGKYFAIEHFDVVPDLVTVSKSLAAGVPLSGVIGRAEMLDAADPGELGGTYAGSPLGCVAALAVLDIIESEQLNKRSEEIGKAIEERALEWKMKYPQIGEVRRLGAMAAIEIVRDEKTREPDKAAAAKIAKYANEHGLLLLTAGINGNIIRFLSPLVITDELLEEGFGIIEEALEQL

SEQ ID NO: 4632 - protein, 463 aa, Bacillus licheniformis
MGKQQMKKTMSQTDVLFLAIGAMLGWGWVVLSGDWISTAGFLGSTIAFIIGGILVILIGLTYAELSSAIPETGGGLIFVYRAFGRKTAFVAAWGVLFGYVSVITFEAVALPTVIDYVLPVEHQGFLWSLSGWDVYVTWVLIGSGGAVVLTALNYFGVKPAAIFQSVFTIAIIATGFLLLGGALVNGDFEHVQPLFKDGFSGMMSVLVMIPFLFVGFDVIPQVAAEINAPKKIIGKILIISIISAVVFYLLIVFGVTMGLSESELATTSLATADAMVNLLGNQLFGTVLVLGGVAGIITSWNAFIIGASRILFAMSEKGMVPKWFGFIHPKYKTPTNAILFLGALAFFAPLLGRPALVWIVNAGGTGIIVGYLIVSIAFMKLRKTEPDLHRPYKINKWKTTGISAILLSVIFLAFYLPGMPAALTWPYEWLILAGWTLIGFLLYNSSSKRKGEEIQHDQHARSI

SEQ ID NO: 4633 - protein, 464 aa, Bacillus licheniformis
MTSMLEVYNPATGEKIKSVPQQSAKEVEEAVVRSHEAFQKWSKTSAAERAGLLKKWFDLIVEQKDELAKLITLENGKPYAEAQGEVLYSAGYIEWYAEEAKRIYGRTVPASVTNKRIIVTRQGVGPVAAITPWNFPAAMITRKAGPALAAGCTFIIKPAPDTPLTALELVRLGHEAGIPKDVLQCVIGDGQEIGSIFTSHPLIRKITFTGSTPVGKHLMKNSAETVKHVSMELGGHAPLIVDEDANIDLAVKQTMLSKYRNAGQTCVCANRLIVHESVKDEFAEKLRAEVAKLKVGNGLEEGVSIGPIINKNGFQKIVDQINDAVNKGAKVLIGAEYESDDEKSCYFVHPTVLTDVDPSMTIMHEETFGPVAPITSFKTLDEAVKLANDTPYGLAAYFFTENYRRGIYLSENLDYGILGWNDGGPSTVQAPFGGMKESGIGREGGLEGIEPYLETKYLSIGLDE

SEQ ID NO: 4634 - protein, 286 aa, Bacillus licheniformis
MKVSVLFVLLAAILWGTTGTTQAFAPKEAAPLVFGAVRMAVGGITLLLFAAFRGQLKRSGWPVKTLIIAALSMAFYQPFFFSAVSLSGIAVGTVVAIGSAPIIAGCLEWLVFKKVPQTKWWIATAAAIAGVALLFIPSASSGGSFLGILLALGAGLSFAVYTLTSKKLLQKQKPEAVTGTVFFLSAVLLAPLLFLYDLGWISSVQGMAVSLYIGVIATGAAYLLFTTGLAKVPASTAVTLSLAEPLTASLLGTVLVRESLPLVSWAGIALLLLGIFYIPISPKRIK

SEQ ID NO: 4635 - protein, 163 aa, Bacillus licheniformis
MKKRTVLFFLLIWLAGCASAQEAEEQTKWVNSEQKAIENGIRYESITKDDIIDKIDLNGEQVVVFRFGDSEGEGIGLAHIKRENGNYQWYRDLNYAIVKSDHPKTENAEASAPFTTPKGRKYTLYTGDADRLNGTFETDDGLHLEPVVDQKTGMYYQIVQDSD

SEQ ID NO: 4636 - protein, 214 aa, Bacillus licheniformis
MLKKTLWMGAILASFLLFSVPVSAHVTVKPTESAAGSWETYTVKVPVEKDNATIKVVLSMPDGVEFQQYEPVPGWKTSTETGKNEKVTRVTWEAENGGIQPGEFQQFTFTAKNPDKEQKAAWNAYQYYKDGTIVEWTGDDDADTPHAITSIVDAAKLGHETVDAHGASTKQNAAAENEDSQGGQGIQTASLILSILAVLLGGAALLLTVRKKKS

SEQ ID NO: 4637 - protein, 548 aa, Bacillus licheniformis
MNVMKRATLWAVLAVLCTILLPKAAFAHAYIVQSTPAENQELKKAPEEIKIEFNEAIQNGFHSITVRNSSGERVDSGKTEIDPQNAKIMTVKLKPKLKDDIYSAEWRAVSADGHPVSGTIPFSIGNIQGGLPKDQQNQASGLPAADIVIERVLLYTGFSLFMGAALFQLVWHRPENGWPGDKKRRLKRITNVALLLTGAAIIIQLPLQTKTNAGVSWIGAFQPSLLKETLLNTTGGTLWLINIAIIALLVFSSNRKGLKSAILSLFLFAGLLFVKSLDGHAASTSAGYMTIAMNFIHLNAASIWTGGLAMFVLFFGKDWLKPDKSLIWETIRRFSPWALASAGLLIFSGLFNSFFIVHTLDNLFGTAYGKALLVKSALVLLMIGLGAFHYFRFRKAPKQQGGRSMKAEWAVGLLILLTTAVFTNIPSPPAPLPQPFSETKQLTEGNTLSLRISPNMPGSNTFEVTVRNRKGDVVKDIQKIELTVEKTGLFGDDKESTFSLSKNKDGVFQTKNLNLSEDGIWKIRVHGLTASFEEIRTVFNAKINKKEF

SEQ ID NO: 4638 - protein, 190 aa, Bacillus licheniformis
MLPIKRREQILAWIKEEESLRISEISKRLNVSEMTVYRDIKPLVENGQVIKTAGGITLNKPKQQLGQLCVVCGKGAGSRLAVQIVKNDSQIEQFCCVHCAMLRYEKVKDDVSQIICRDFLLDTTISAKAAVFLLDTDLHLNCCEPHALPFASEAEARKFKKGFGGQLLSFDDAALLVQKTMKNSCCSLKT

SEQ ID NO: 4639 - protein, 764 aa, Bacillus licheniformis
MGKQRLVLIGNGMAGVRTAEEISLHGGSRFEIVIIGSEPHPGYNRILLSSVLQGETDWNDVMTKSRSWYEENGITLYTGETAVAIDTVNQTVATDQNREIAYDKLIIATGSSPFILPVHGADKEGVYGFRTIDDCRAFINASKRFKKAAVIGGGILGLEAARGLANLGMKVDVVHHSSSIMQTQLDPPASAMLQKELERQGIHFLLEKDTEAILGTSRAEGVRFKDGTKISADLVVMAAGVRPNIELAKASGISTNRAIIVSDYMETNVPNVYAVGECAEHNGTVYGLVKPLYEQGKVLAKHICGLECSGYQGSVQSAALKMSGIDVFSAGKITEDDSTTAIKLLDEAAGVYKKAVFQGDKMAGVILYGDTSGSQRLLESIIKQRDITVVKKELFQSEEDSSVASMAVRETICQCNAVSKGMIMEAIQTHGLKTAEEVKRCTKASGSCGGCRPLVEELLLHTAEHDGHISAAEQPMCACTSFTEDEVVNEIQMRNLSSVHEVISALGWKNSSGCRICVPALHYYLKMIRPDIAYEEHEEETDAIIPQMYGGRTNAEELKRIAGVIEKYQIQEVYMTHHQRLKLAGIKPEHIERVKEELGMPYCLPQQQRIAAVKTCPCGSPQIQTLAADLEKAAESLLIPAKVSIGVSGCLDDCVYASVHDIGLLKVNGGWEIYAGGQGGQHASPGELLSVADSAEEAGELMKGLLQYYRETANYLEKIGHWIERAGIIHIREVLFDNGLRGQLFERLEKEKRLAQQEMIKGLM

SEQ ID NO: 4640 - protein, 719 aa, Bacillus licheniformis
MTERLLKYFRTKQKEVQSEKTYDTQCPFCSMQCKMQLIEQTIVTRKKYTAVGKDNPTTKGRLCMKGMNAHQHAFHSERITHPLIKKNGEFVRVSWEEALQYIKEQVTAIQHEDGRDALSVYGSASITNEEAYLLGKFARVALKTKHIDYNGRLCMSAAATAANQTFGMDRGLTNALSEIPHARVIILAGTNIAECQPTIMPYFEEAKQNRAYIIVIDPRETATAKIADLHLKIKPGTDAALANGMLKIIIEEQLTDGAFIRDRAEGFEEVKRHVASLSLEDISAKTGIQIEQIKKAAVKFAREETGMLFTARGVEQQTDGTAAVRNLLNILISTGKIGKYACGYGAVTGQGNGQGAREHGQKADQLPGYRSIENEADRAYIADVWGIKAEDLPGKGVSAYEMMKKVHEGEITGMFLMCSNPVVSSPTAGFVKSALGKLKFFAAVDLFLSETAILADVVLPASSYLEDEGTMTNLEGRVTLREASKPCPGEARHDWQIICDIAKALGKGRYFSYRSAEDVFNELRKASRGGIADYSGITYERLRKEGGILWPCPEEGHPGTQRLFESSFSHPDKKARMCVVPNEPKVKKDVPTEEYPLILTTGRVMSHYLTGVQTRRSAALKARHFESFMEIHPKTAEKYNIGDRVLVRVESKRGSIIVRSKWSEAIRPDTVFVPIHWADSQNVNDLIAETLDPSCSMPGFKVCSVKIRPSVDNFVNKLS

SEQ ID NO: 4641 - protein, 806 aa, Bacillus licheniformis
MKKKQLVLVGNGMAGVRAIEEILKISNEEFQITIFGSEPHPNYNRILLSKVLQGDTDVKDITLNDWDWYEENGIQLYTGEEVVKVDPESKTVITDTGRVQPYDELILATGSLPFILPLPGADKEGVTAFRDIKDTDIMLEASKTYKKAAVIGGGLLGLEAARGLLNLGMDVTVVHLAPYLMERQLDAAAGRLLQKELEKQGMKFLLEKQTEEIYGETRVEGLKFKDGSTLEADLVVMAVGIKPNVQLGKDCGLPVNRGIVVNDYMETEVPNIYAVGECAEHRGIAYGLVAPLYEQAKVLAKKICGVETAPYEGSVLSTQLKVSGVEVFSAGDFNEDDGEDKKALKVFDEQDGIYKKIVLRGNQVIGAVLFGDSSEGNRLFSMIQKGADISDTSKISILQPLNQEEGMSLTAAMSDDEIVCGCNGVSKGMIIQAIKEQGCTSTDEIKACTGASRSCGGCKPLVAEILQHTLGSEFDASAQKEAICGCTDLSRDELVAEIREKGLTHTKEVMNVLGWKTAEGCSKCRPALNYYLGMINPKEYEDERESRFVNERMHANIQKDGTYSVVPRMYGGVTNSNDLRRIADVVDKYEIPLVKMTGGQRIDLIGVKKEDLPKVWADLDMPSGFAYGKTLRTVKTCVGEQFCRFGTQDSMALGIDLEKKFEGLYTPHKIKMAVSACPRNCAESGIKDIGVVGIDGGWEIYVGGNGGTHLRAGDLLMKVKTAEEVIEITGAYLQYYRETANYLERTSAWIERVGLSHVQSVLNDKEKRKELNDRINQALSVHKDPWKDFLEDGKTTRQLFENVVTS

SEQ ID NO: 4642 - protein, 106 aa, Bacillus licheniformis
MVNKNLTKVFVSKIGDLPNQLGKTVFIKDKEIAVFKLSNGSVRAIENRCPHKGGVLAEGMVSGEFVFCPMHDWKISLEDGKVQEPDTGCVQTYETVVEGEDLYIVY

SEQ ID NO: 4643 - protein, 486 aa, Bacillus licheniformis
MGNGKVYFVGAGPGDSGLITLKGRTLIEAADVILYDRLVNSRLLEHAKASCEFVYCGKLPDRHYMRQSEINALLIEKGLKGLKVVRLKGGDPSVFGRVGEEAAAVSEHGIPYEMVPGITSGIAAPLYAGLPVTHRDFASSFAVVTAHDKSGKPEMNWEGLAKGVQTLVFYMGIKNLGYICEQLMKHGKSPLVPAMAIQWGTWGRQRSVKGTLQNIREKITEHQIKNPAIIVIGDIVSFRQNSWFEEKPLIGLNIMAVKSCEEEQIPVEALREQGAEVVEWPKWKSAETVPDDALLGRIACFDSLLFTSSASLRRFFSRLAALKIDVREMRGRLYASDQHVKAALEERGFEAFLQTEMPVSGSCLLIGSREAVQNYPHSGCEVLITHDRVIDSRFTSIIKREIDEFPIDIVLFSNRTCVELFVNEAETVGLHPEKTAARLQAFCLTEEAGERAAAVGFQRVHAVNDRDRLPDVIKEINRTAEFVCQS

SEQ ID NO: 4644 - protein, 226 aa, Bacillus licheniformis
MKFSIQRAVSYHDQVHHYLKDMIIKGGYQPGERIYESKIAKELQVSRSPVREAIRTLEQEGLLLIDDKSKITVYEPTIKDLEEIYQCRQALESLAVSLATRLASNETLELISETLSEAHKHQKSQGPESANALLRLNTQFHDAIIEASENERLQKQLLDLRSLTFFYRSKNLEKPERTLEIINQHEEILRHMQDRNDAKAAESMRKHIEADLCYLKEVLFRSSAAR

SEQ ID NO: 4645 - protein, 546 aa, Bacillus licheniformis
MKSSVVSAWDMLWRSHREAKRLLLFAMPVRAGKDAGLKINSEQTMKEEKPPSYKTPQKIGLLLGPALFFAVLLFFFPEGLSYEGRMVLATTLWVAVWWITEAVPIPAASLLPIVLLPLTGALEGAAVTSSYGDPIVFLFLGGFLIALAMERWNLHKRIALNIISVVGTSTSRIVLGFMAATGFLSMWVSNTAAVMMMLPIGTAIIHQVSAVIKSERKDLAAEEAKFSKALIFSIGYAGTIGGLGTLIGTPPNIILAANIKKLYGVEVSFGGWMAFAVPVVVILLVAVWLYLTKVAHPIKMKELPGGKELILEEKRKLGKMSFEETMVLLVFGFAAFMWVTRTFLWDDKIPGIDDTMIAIFAASLLFLIPSLNKGGRVLDWSVSKDLPWGILLLFGGGLALATGFKETGLAEWIGGRLTVLDGFNFVVIVIISTALVLFLTEITSNTATATMILPVLASLALALNVHPYALMVPAAMAANCAFMLPVGTPPNAIIFASGKLKISEMVRTGFVINIFTLILIVGAVFYILPHLWGVDLTVFPDNLKSN

SEQ ID NO: 4646 - protein, 73 aa, Bacillus licheniformis
MKEPAEIGFLSSVKKAECTGKAVVGDKLDLYFEVSRYKRGFLFGKGTASVNGKPAVKAEIGIFMEQSESGGED

SEQ ID NO: 4647 - protein, 155 aa, Bacillus licheniformis
MIEIKPVAFVENLRTFPKDDHWGDVISEIKLAEGIHPDALKGIEEFSHLDIIFYFHQVKEEHIQYKARRPRNNKNYPETGIFAQRGKNRPNRLGATVVTLLEKSGSKLVVKGLDAIDGTPVIDIKPVMKEFLPKGQIIQPKWSEDLMKVYWHAAD

SEQ ID NO: 4648 - protein, 683 aa, Bacillus licheniformis
MINEKRPAQLLQYLLRVREATMHQLIDHFQLSKRQICYDLDKINHWLTGKQLPEIEYKRKNRLAVPETLLELRFSEACSDIGRSFIFTQEERIKALYMFLFVRREPISSAHLTQLLQVSKNTVMNDVKKANEALTPFLVAIKYTRQRGYHLIGSEFDKRVPVMHHLSSFLQKPYGKEILHYILKISGSRDHKQQEFKRAVELVSKEYGLQLVEERLNEFIYFLMMYSIRVAEGKIVRFHQEEGELLKQSPLKNAAVRLVNELRIPVHETELCYILIQLLGLSFGQQPAHDPLYQLCEKLVFEFESRACITFPRRREVAESLYRHLKPAYFRMKYRIPIHNPLLSKIKKEHKELFTIVQKLMRHLEALLNKPVPEEEIGFITIHFGALLEQPVQSGSSKKTAVVVCPSGVSSSLMVRRQLESLFSEIVVEKAMSLQEFTPDVFDHYDAVFSTVELKTKKRYYMVRPLMTPAEKSRLVNEVYQEMFGVKQRELLTDEFLHILKKHASIIDEKGLRESLKNIAFVQKVTETRGKRPVLKDLLTDETIQMADQIKGWEEAIQTAAKPLLDKEVILKEYTDAMIDNVKTMGPYMIIGPEIAIPHARPEKGVQKVGMSLLKLKEPVYFLDDEQYPVRLLFCIAAVDHTTHLKALSQLTRLLSNKENQDSLKETESLEHIKRLIEAYSSN

SEQ ID NO: 4649 - protein, 93 aa, Bacillus licheniformis
MKILAVCGSGLGSSFMLEMNIKDILQEMGLMEIEVDHSDLSSASPDQADLFIVAKDIAEGAAHLRDIVVLESIIDMDELKTKLVKTLQEKGVL

SEQ ID NO: 4650 - protein, 457 aa, Bacillus licheniformis
MGERALKLMMDVLSQPAVLIAAISLIGLLLQKKPANEIVKGTTKSFLGFIVISAGAGILVGSLEPFGKMFQAAFHVNGVVPNNEAIVAMALNEYGTATALIMFFGMLSNILIARFTRLKYIFLTGHHTLYMACLIAVILAVAGLKGPFLIGVGAVSLGLTMSLFPAMVQPFMKKITGNDKVAFGHFSSIGYAVSGLIGKAAGKGSRSTEKIRFPNGLGFLRDSSVSIALTMTILYVLIALFAGAGYVERELSGGTHYLVFSVIQAVTFAAGVFIILSGVRLVLAEIVPAFKGISDKLVPDSKPALDCPIIFPYAPNAVLIGFFCSFIGGITGMLILGAAGAVIVLPGVVPHFFTGASAGVFGNAAGGIRGAVLGSFVNGLIITFFPVFLLPVMGDLGFANTTFSDTDFAATGIVLGHAVKLLGSGGVVIGIAAVVVGAVLFGFKRGKAEKPDQKVEA

SEQ ID NO: 4651 - protein, 280 aa, Bacillus licheniformis
MSVREIDMERFRDQIRLLTLKQLHHLGFGHYGGSLSIADVLAVLYGKVMKIDPANPSWEDRDFFILSKGHGGPALYAALHLSGYFEEDVLYTLNQNGTALPSHPDRNLTPGVDMTTGSLGQGISAAAGVALSHKLSGRANRTFVIVGDGELNEGQCWEAIQFAAHHKLRNLYVFVDDNKQQLDGPTKEIIDPLDFVSKFRAFGFYSERVNGHEPEAIYRAVKRGEAQRERPVAVILDTVKGKGIPYFEKMENSHHIRANEEQNRMIERIILTLEEKEVRA

SEQ ID NO: 4652 - protein, 316 aa, Bacillus licheniformis
MNEAANVELDAVEMRQAYSSAVYELAQENTDIVALEADLMSSISMDKVKRRIPEQVINCGVMEANMIGIAAGLSLTGRIPFVHTFAQFATRRCFDQLFVSGAYAKTNIKILGSDSGITAEHNGGTHMAFEDLGLARLIPNAFVYEASDAAMLKFLIKKAAAEYGIHYIRTIRKKAVRLYDEHETFADGKAKVLKDGSDAALFASGIMVAEALQAAELLKEKGIDAAVIDMYCIKPIDQETVVRYAQKTNAIVTAENHNVIGGLGSAVAEVLSEHYPAPLKRIGVHEAFGQVGTIDYLKKSYRLTAEHIALAAEQLV

SEQ ID NO: 4653 - protein, 251 aa, Bacillus licheniformis
MSVSQRNRIDVKLVALDMDGTLLNDEQTISDENRKAIKEAEEKGVYVVLSTGRTLMTCRELAESLELSSFLITANGSEIWDSSFNLVERQLLHPDHVQMMWDLRNLHNTDFWAASVDKVWRGEFPEDIQAYEWLKFGFDIPDDDVRNRVLEELKKNKELEVTNSSPTNIEVNAIGINKAAALAKVCERLGFTMEHVMAVGDSLNDIAMIKEAGLGVAMGNAQEIVKETADWITDSNIEHGVAKAIRHWVLS

SEQ ID NO: 4654 - protein, 253 aa, Bacillus licheniformis
MNQVDLNCDLGESFGAYKIGLDEEILEFVTSANIACGFHAGDPGVMRKTVKMAAEKGVKIGAHPGLPDLAGFGRRNMAITPEEAYDLVVYQIGALSGFLKAEGVTMQHVKPHGALYNMAAQSRELSDAIARAVYQTDPELILFGLAGSELVLAGERAGLKTAHEVFADRTYQEDGTLTSRRQNDALIQDDDEAVGQVIRMVKEGKVRSLQGTDVSLKADTVCIHGDGAHALHFAKKIRRELRAADIKVQAFST

SEQ ID NO: 4655 - protein, 403 aa, Bacillus licheniformis
MKQNKKTKAPAGNWTLLLGAAFLMATSAIGPGFLTQTTVFTQSLAASFGFVILVSIILDIFAQTNVWRIIAVSEKRGQEIANLVLPGLGYFIAFLVVLGGLAFNIGNIGGAGLGMQVLFGISPQMGAIISAVIAILIFVIKEAGKAMDRFTLIAGFVMILLTVYVAVTTGPPVGEAITKTVMPDNIDYLAIITLVGGTVGGYITFAGGHRLLDAGVKGKDAIPEVTKSSVSGILITSVMRIALFLAVLGVVSKGMQINPDNPPASVFQHAAGNVGYKIFGLVMWSAAITSVIGAAYTSVSFFKTFSPKIEKNSRGIIIVFIIVSTLCFVTIGKPVNLLVLAGALNGLILPIALGSLLIGAHKKNVIGDYRHPIWLTIPGILVVIVMAIMGGYTLINEIPKLWG

SEQ ID NO: 4656 - protein, 262 aa, Bacillus licheniformis
MHVNEMRPDEVRALIRKGEITGPTAGMAGGFTQANLVILKKELAFEFLLFCQRNQKPCPILDVTDPGSPVPSITAPDADIRTDFPKYRVYKRGELADEVTDISSLWEDDMVGFLIGCSFTFEQALMNNGIPVRHIEEKRNVPMYQTNIPCVPAGRFQGPMVVSMRPVPEEQAVRAVQVTSRLPAVHGGPVHIGSPEAIGITDIAKPDFGDAVTIKKGEVPVFWACGVTPQAVAMHARPELMITHSPGHMLVTDVRDEQFGVL

SEQ ID NO: 4657 - protein, 244 aa, Bacillus licheniformis
MKNLSNATMSPLGDSAVIIQLGEGISEQTHRVVSALTKRIENDPFPGFIECVPAFTSVTVFYQPFEVYRKMESGKAVDSPYEKVKALLDHHLQELTMEEETDQRTVEIPVCYGGRFGPDLEEVADINGLTAQEVIDIHTSGEYLVYMIGFAPGFPYLGGMSEKIAAPRRSSPRTSIPAGSVGIAGMQTGVYPLSTPGGWQLIGNTPLELFKPYEQPPSLLRAGDIVKFVSVTEEEYHALKEGKS

SEQ ID NO: 4658 - protein, 337 aa, Bacillus licheniformis
MSIEVLKPGLMTTVQDLGRTGFQKYGVLVSGAMDADSLRIANLLAGNSQNEAALEVTLMGPGPSLRFQKPALIAVTGADFSLMVNDEEVPLWRPVFIKEGSVLTFGMCKRGSRAYMAVAGGIDVPPVMESKSTYVRAGLGGFQGRALQKGDVLSLGSPTPLSEALHRKLADEGKERGFAAPKWAVDRKYFLPLKKNPVIRVIKGDQFACFTSSSQERFFAGPFRVTAKSDRMGYRLQGEALELTQPLEMISEAVSFGTIQVPPDGNPIVLLADRQTAGGYPRIAHIASADFSQVTQMMPGEQVQFQLVSLQEAERVYIERETKISELSARLKLEYML

SEQ ID NO: 4659 - protein, 249 aa, Bacillus licheniformis
MEHKNKTVVKAMTLLNLFLTRERLSLGDMIELTGMPKTSVYRMVCSLEEMGFLDRDENGMYSLGLLFLQYGHLVSERLDIRKIALPIMEELRDDVDEAVHLIVRQGNEAMYIEKIEGTQTVRLYTAIGRRSPLYAGACARSILTFLPEEERDAYIEQTELVPIASGTIRDKAELIRIVDESYRSGCTVSHSELEDYTSAIAAPIFNHKREVAAGISIAGFEARFQKDRLPYLTERVKKAALDISRKLGF

SEQ ID NO: 4660 - protein, 212 aa, Bacillus licheniformis
MTLQYTALGDSLTVGVGAGLFEPGFVQRYKRKMEEDLNEEVSLIVFAKSGLETSEILAMLNEPFIMEQVKKADVITITGCGNDLLQSLEIYEKEKDEHVFLEASSHCQKNYSGMLEKIREIKGEKDTRYLVRLLNLYNPFPSIELADKWISGFNRHLKQLESAPQIKVIDTYAVFKGREKEYLSIDRVHPSSRGYEAMSEKLRAAGYGRLEG

SEQ ID NO: 4661 - protein, 474 aa, Bacillus licheniformis
MEDRQNQDFKVKIQRFGSYLSGMIMPNIGAFIAWGIITALFIPTGWMPNEALASLVDPMIKFLLPLLIGYTGGKMVYDHRGGVVGATAAIGVIVGADIPMFLGAMIMGPLGGYLMKLTDRLFKDKVRSGFEMLINNFTAGILGFILAVLGFLAIGPVVLGLNKTLAAGVEVIVNANLLPLASIFVEPAKVLFLNNAINHGILSPIGIEQAAQTGKSILFLLEANPGPGLGILLAYMIFGRGTSKQTAPGAAVIHFLGGIHEIYFPYILMKPLLILAAIAGGASGVLTFSIFNAGLAAVPSPGSIIAVLAMTPKGNHIGVILGVLVAAVVSFIVASLILKTSKAGEEDLTAAAEKMQQMKGKKSQAVSALTSADEAEESAAPYENVSKIIFACDAGMGSSAMGASILKNKVKKAELDIDVSNTSINNLPEDADIVITHKDLTERAKAKLPSARHISVENFLNSPKYDELINQLKK

SEQ ID NO: 4662 - protein, 379 aa, Bacillus licheniformis
MIALHFGAGNIGRGFIGALLCKSGYDVVFADVNDAVINELNDKGRYTVEMADAGRKQETIGPVRAINSATQLDELYDLIAKADLVTTAVGPAVLKLIAEPIAEGLKRRMKINKQPLNIIACENMIGGSAHLREEIFARLTETERAAISDSVGFPNSAVDRIVPIQHHDDPLKVTVEPFFEWAVDQTEFAGKVPDIEGVTYVADLAPFIERKLFTVNTGHAMAAYAGYKKGLKTIKDAIHHPEVRQTVAGALEETGRYLVQTYDFTQEEHRAYMTKIIGRFENECLSDDVTRVARSPLRKLGRDDRLVGPARKLCDLGFEPVRLAEGIALALQFDCADDPEAVQLQSMIAEKGYAGVLRDVCGLEEDHSLFKLVISHLKA

SEQ ID NO: 4663 - protein, 682 aa, Bacillus licheniformis
MKYLLHQNRYVKVNEIAGYIEVSTRTVHRELKAVKSVLDKYRLQLDKQPGKGLKLVGAYRDKQRLLEDLSRDSHVEYSADERKLLILCAMLETGEPIKLYTIAHDLQVTAATISNDLDELEKWIAPFGLSLIRKRGYGIELRGPEDAKRKIVGNLMADKLDVQQFLETIEMNIKGKNEAPEKIFGVVSRGKLLKAEKVLFQMKEKYGLSLSDSAYIALVVHLTFAIERIQLGEMINMNEEELTDLKRTKEFELALALAKALEDAFHVKIPEAEAGYITMHLRSANKSFKIDYRAEDIELDTALRTKKLIDFISQKTGMNLTGNHSLYEGLIAHLEPAIIRIKEKMSVHNPLTEQVKKDYFLLYMAIEEGVEIFFPEIRFPDEEIAFIVLHFGSALEMSKQKVDINALVICSSGIGSSKMLASRLKKELPEIASFEISSLMELKTKNTDAFDIIVSTVPIPYENIDCVTVSPLLDTEDVKQIKHQLTRKIPLILRKKRMAPKKPEPFPDMLQIARKIGHYAAGIQHILSHFTVETMEAESSLEHTVKRICGTLEDQGLVKDAGQMADGLMKREAQGGLGIPGTTFALFHLKSEAAAVPLFKAYDLSKPFEIKGMDGSAMKMMRMLIMLAPADLSPEGSEILSFISSSMIESDESIKAYQTGDREQLYGMLNVLFHRFIQDKEW

SEQ ID NO: 4664 - protein, 289 aa, Bacillus licheniformis
MDLRNQQTNGQPAQTQDRQPGIESVMNPRPIYEDENYKGTDKLKGKVALITGGDSGIGRAVAVAYAKEGADISIVYLNEHEDAQETKARVEKEGVKCLLLPGDVRDEAFCNDAVEQTVKELGRLDILVNNAAEQHPKDSIKEISSEQLEKTFKTNFFSYFYFTKKAIDYLEPGSAIINTTSINPYRGNPQLIDYTATKGAINAFTRSMSQALVKDGIRVNAVAPGPIWTPLIPSTFSGEEVAKFGTDTPMGRPGQPVDHVGCYVLLASDDSSYMTGQTLHVNGGDFITT

SEQ ID NO: 4665 - protein, 167 aa, Bacillus licheniformis
MKVTKEDVIEYYEKAGIVLNDDDKENIQIMDYGLNKLDKLGLQLFVYVNTDRYCAKELVLFPEQTCPEHRHPPVDKQKGKEETFRCRYGKVYLYVEGEKTEAPAVMPPDEDIEHFTVWHEIQLTPGEQFTIPPDTKHWFKAGSEGAVVTEFSSTSTDDHDVFTDPRI

SEQ ID NO: 4666 - protein, 127 aa, Bacillus licheniformis
MNIFISFDAEADMGYIALTERRAGSVSATDDIGDTALSADFDRHQRIIGVEFPGDEAPEIARLGTLTGRKYKLEPAYLNGTHVRRFRPTAQEAVKTLCVNGVQFYFADHDGRHFIGFDVMERAKKSE

SEQ ID NO: 4667 - protein, 140 aa, Bacillus licheniformis
MDQQQLKNKVLDILDHHKIGSLATVESGKPHSRYMTFFHDGLTLYTPTSDETHKAEEIDNNPNVHVLLGYNGEGLGDAYLEITGTAKLNHSKDLKDKIWDERLEQWFDGKDDPNLTVLEIEPSEIRLMNEGESTPVTLDM

SEQ ID NO: 4668 - protein, 269 aa, Bacillus licheniformis
MDFLTSKVLLIFCFLLLIHSIETLAYAARLSGARVGFIASALSLFNVMVIVSRMSNMVQQPVTGKLVDVAGADALSLVGSQFRFLIFGSTVGTIFGMLLLPTFVAVFSRAIVHLAGENGSVLQVFRKAFSKNSFKHAKHYAKRPSLEYVKDFRFRYIPKRLFVLNMVITAIYTIGVLAALYAGVLVPERHTTAVMASGLVNGVATMLLALFVDPKVSVLADDVAKGKRSYTYLKWASITMAASRVAGTIFAQVLFIPASYYIAWMTKWM

SEQ ID NO: 4669 - protein, 313 aa, Bacillus licheniformis
MERVRVRVRKPKRKRRKIIKRLFTLTLLVIIAAAGYTYFEYKKGLSESDGDFKEDGQFEFNGEGSDLDEVNILVLGIDSRGEDHSRSDSMMVIHYNKKQKQPKLISIMRDSYVDIPGYDKQKVNAAYAYGGPELVRKTLKESFDLDINYYAVIDFKGFAKIVDAVAPDGIEVDVPKKMSYGIGMTLQPGKQVLHGERLLGYVRFRHDRESDFGRVRRQQEVFSKLQKEAVSIGNIAQLPKLWGLVDPYIETNIPNGVILSVGKDFLLGSVKETKSFRLPVDGSFTNKDDPKYGAVLDLDLEQNKEELKRFLNE

SEQ ID NO: 4670 - protein, 97 aa, Bacillus licheniformis
MLQTPIGRLRLMGFIEGMSLLILLFIAMPLKYWADYPMAVTIVGSVHGGLFILYLFVLLYATFVLRWSVKWPAAGLVAAFVPFGNFLYDRGLKKYDQ

SEQ ID NO: 4671 - protein, 136 aa, Bacillus licheniformis
MTRINFSDRGETPFQRLLGHSESLMSSWTALAEELSGDGFLSKELKEQVRRVLAQGNGCEYCKAKGKPEIPNQQKTSFAMGFAEVFLAQRERVSDRQFDVLKEVFSEEEITELTAFICFTTAQQYFGALMKLPADA

SEQ ID NO: 4672 - protein, 142 aa, Bacillus licheniformis
MKIDDLDFKIIAELKKDSRLSMRELGRKISLSAPSVTERVRRLESFGVIKKYTLDIDYQKVGLPVSCIIEATVKNGEYERFKAYIERLPNIEFCYRIAGAACYMLKINAESLAKIEAFINETSPYAQTVTHVIFSEIETKES

SEQ ID NO: 4673 - protein, 730 aa, Bacillus licheniformis
MMDVSKTVVLAEKPSVGRDLARVLKCHKKGNGYLEGDRYIVTWALGHLVTLADPEGYGKEYQSWRLEDLPIIPEPLKLVVIKKTGKQFQAVKSQLIRKDVKDIVIATDAGREGELVARWIIEKAKVTKPLKRLWISSVTDKAIKDGFKNLKNGKDFENLYHSAVARAEADWIVGINATRALTTKFNAQLSCGRVQTPTLAMIAKREEDIKNFKPVPYFGLRAAVDGMTLTWQDKKTSQTRTFNASVTSQLAGALQGKPAVIVDLKKTAKKSFAPGLYDLTELQRDAHKRFGFSAKETLSVLQKLYEQHKLVTYPRTDSRFLSNDIVPTLKDRLEGMQVKPYAQHVARILKRGVKANKSFVNDAKVSDHHAIIPTEEPLALGALSEKERKLYDLIAKRFLAVLMPPFEYEETKVFAEIGGETFTAKGKTVQSQGWKAVYDFADEDDDEEEKDQTLPKLAKGDTLSVRSLTETKGETKPPARFNEGTLLSAMENPAAFMQGEEKNLVKTLGETGGLGTVATRADIIEKLFNTFLIEKKGKDIYITSKGKQLLELVPSDLKSPALTAEWEQKLSGIAKGKLKSSAFIKEMKEYAKQTIREIKSSNQKFKHDNITGTHCPDCGKLMLKVNGKRGTMLVCQDRECGHRKTVAKQTNARCPVCHKRMELRGHGEGQTFACVCGHREKLSVFEKRRAKDKNSKASKRDVHSYMKKQNKDEPINNALAEQLKKLKLDQ

SEQ ID NO: 4674 - protein, 50 aa, Bacillus licheniformis
MRGDFPKAESVFIQERLTRISTLIGIQNILMFQSDFPGRGYMNFPVFSAQ

SEQ ID NO: 4675 - protein, 37 aa, Bacillus licheniformis
MWQGNFSEVEHSRKTKHDISIFSFALSGLRKELMYNQ

SEQ ID NO: 4676 - protein, 38 aa, Bacillus licheniformis
MLFFQYFFAQKSAEAKAPAESDFYSQVISLSLNAYEVS

SEQ ID NO: 4677 - protein, 182 aa, Bacillus licheniformis
MYSAIKRFLIGKPLKSKELREQKITKTKALALLSSDALSSVAYGTEQILIVLAAVSSAALWYSLPIAAGVMILLTALILSYRQIIFSYPHGGGAYVVSRENLGVNPGLVAGGSLLVDYILTVAVSVSAGTDAITSAVPMLHPYHLLIAIVLVLLIMVLKFTRADRIRLQYWHTLCIYLWPLF

SEQ ID NO: 4678 - protein, 437 aa, Bacillus licheniformis
MAYPVYLFVAALLILIAAGSYKLLTGQIEPAEHAAVGTPVAGLSLFLLLKAFSSGCSALTGVEAISNAIPAFKDPAPKNAANTLAMMGILLAVLFSGITMLAFGYGITPKSEETVVSQIASETFGRSFLYFFIQGTTSMILVLAANTGFSAFPQLAFNLARDKYMPRMFTVRGDRLGYSNGIIFLGIASIVLIVLFNGQTEHLIPLYAVGVFIPFTLSQTGMCLKWMREKPDGWIAKMIINAAGAAISAVVLLILFITKFALVWPIVIFMPIVIWAFYVVKKHYTAVSEQLRITGKPLEPIKGNIVIVPVAGVTSVVEKSVQYAKTLSDQVIAVHVSFDKEEEKKIEKKWEALQNGVRLVTLYSSYRSLIHPLEKFLETVEAKAASYNYSVMVLVPQFIPKKSWHNILHNQSALLLRLRLLWKKDIVVATLPYHFKK

SEQ ID NO: 4679 - protein, 573 aa, Bacillus licheniformis
MANKTAGKIAAELLKEWNIDHVYGMPGDSVNEFIDELRHEENSLRFIQVRHEETAALAAAADAKLTGKIGVCLSIAGPGAVHLLNGLYDAKADGAPVLAITGQVSSDEIGRDYFQEIGLERMFEDVALFNQQVHSAEALPDLLNQAIRTAYSQKGAAVLSVSDDLFAEKIKRKPVYTSALYIEGDLEPKKSQLMQCAQLINQAKKPVILAGRGMKSARDELLEFADKAAAPIIVTLPAKGVVPDRHPHMLGNLGHIGTKPAYEAMEESDLLIMLGTSFPYRDYLPEDAPAIQLDNNPAKIGKRYPVTAGLVCDAKKGLFELTKTIERKSNRAFLESCIQHMRKWRYEVEKDEQVATEPLKPQQVIARLEDAVADDAVLSVDVGNVTVWTARHFNMTNQDFLISSWLGTMGCGLPGAISAKLSHPERQVVAVCGDGGFSMSMHDFPTAVKYELPIVVVILNNQNLGMIQYEQQEKGHVNYATALENVDYAKFAEACGGKGFSVTKHEELIPALKSAFHSQKPSIIDVAIEDEPPLPGKISYTQAVNYSKYMIKKLVEKKELDLPPLKKSLKRIF

SEQ ID NO: 4680 - protein, 203 aa, Bacillus licheniformis
MYRLPKTTFSTVFILAAGLLWMSIVPQQAFAHGFIEKPGSRAALCSEAFGFLNLNCGSVMYEPQSLEAKKGFPHSGPADGQIASAGGLFGGILDQQSENRWFKHIMTGGEHTFTWTYTAPHNTSQWHYYITKKGWDPDKPLKRADFELIGAVPHDGSPASRNLSHHIYIPEDRLGYHVILAVWDVADTENAFYQVIDVDLVNK

SEQ ID NO: 4681 - protein, 286 aa, Bacillus licheniformis
MEPRVIVQVVEELSATFKIIDILGVLGIPKSTYYRWKKKYKKVELTSLEELVIKLCKKNFYHYGHRKIKSILNRKYGINVNRKTVQKIMQKFEIQCQVKKKRQKYICGESNIIVPNTLNRNFKASRLNEKWVTDITYLPYGSTMLYLSTIMDLYNNEIVAYKIGTSQDINLVLDTLREAVELRKPVGLLLHSDQGSVYTSHAYQNLAKEKGITTSMSRKGNCHDNAVIESFHSSLKSEGFNAQSRASISNSKVVQIVNQYMYRYNHVRIQAKLNYLSPLEYRGQAA

SEQ ID NO: 4682 - protein, 110 aa, Bacillus licheniformis
MGTRVHYAEEVKWEVIKMKQAGMTNKEIMEQLGIKNKTQIKTWMRWYKTGQTYRFSQQVGKQYSYGKESEEMSELEELKLKNKQLEAQLAIIKKYQEIERSWSHESLSKL

SEQ ID NO: 4683 - protein, 85 aa, Bacillus licheniformis
MNMKVFILFYLWIVPLVIGLIFFRVTQRTSFKKRFYPGYIMIVLAAAVFAVCYLIGQPYLGNFFGGTMLFGTLLPFMAAAMKKKK

SEQ ID NO: 4684 - protein, 183 aa, Bacillus licheniformis
MFKLMVRDDLYLKMLEPKDARAVYMQIQQSKDVLRKWLFWVDGTKQLEDTEAFIEESMKQAAANNGFQAGIWHQGQFAGIIGLHYINWINRTTSIGYWLGEPFQGKGMMTDACRALIDTLFSEYDLNRIEIRAAVQNVKSQAIPERLGFTKEGCLRQCEWLHDHFADHFVYGLLKEEYEARSK

SEQ ID NO: 4685 - protein, 426 aa, Bacillus licheniformis
MVSHDLSKHSQISKEAQDALDGKSKGFKRLLPFLGPAFIAAIAYIDPGNFATNIAAGSKYGYLLLWVILFSNIMALLIQSLSAKLGIATGKNLPEVAREEFPKPVSIGLWIQGELVVIATDLAEFIGAALGLYLLFGIPMLEASIIAAAGSFAILELQRRGVRPLEAAITGMLFIVVIAFAFQTFFAKPDIGSVLEGMFVPRFDGADSILLAAGILGATVMPHAIYLHSALTQRRVVGKTEAEKKKIFRFEFIDILIAMLIAGAINASMLIVAAALFYKNGIFVEDLDVAFSHFSSMVSPLSAVLFGVGLLTAGLSSSSVGTLSGDIIMQGFINFRIPLYLRRFITILPPIAIIASGVNPTTALVLSQVVLSFGIAFALIPLILFTSNKRIMGSLKNAKWITAVSWLIAALIVALNIFLIYDTFSG

SEQ ID NO: 4686 - protein, 82 aa, Bacillus licheniformis
MLGFLVSLIVAIVIGLIGGAIGAHGAPGSMVIGFIGAWIGHGLFGTWGPDIAGFAIFPAIIGAAILVFILNLIFRGRMGSQA

SEQ ID NO: 4687 - protein, 473 aa, Bacillus licheniformis
MDTKATRIEKDFLGEKEVPVDAYYGVQTMRAVENFPITGYQIDEELIKALAMVKKAAALANMDIKRLYKELGEVIVKAAGEIAEGLWHEHFIVDPIQGGAGTSMNMNTNEVIANRGLELLGKEKGDYFHLSPNTHVNMAQSTNDVFPTAIHLATLNHLKRLLSTMEHMLDAFRKKAAEFDSVIKMGRTHLQDAVPIRLGQEFEAYSRVIERDIQRIRQSQHHLYEVNMGATAVGTGLNADPRYIQNVVAHLSDISGYQLTGADHLVDATQNTDAYTEVSAALKVGMMNMSKIANDLRLMASGPRAGLAEIRLPPRQPGSSIMPGKVNPVMPELMNQIAFQVIGNDNTICLASEAGQLELNVMEPVLVFNLLQSIKIMNNGFRVFTDYCITGIEANEIRLKEFVEKSVGTITAVNPHLGYEAAARIAKEAIATGRSVRELCLLHDVLTEEELDLILDPYEMTHPGIAGASLLEE

SEQ ID NO: 4688 - protein, 394 aa, Bacillus licheniformis
MGHVLMINFPGEGHINPSIGVTKELQRRGESIVYYAVEEYAEKIKKTGAEVRLYPDFREVLSPGKKKEKMDFAEVVYNMSSKVNEIVQFIYREVKSESYDYVIYDHHFLAGKIIAEMLELPSVSLCTTFAMDEQFAKTFTPQGDLESSPYFEKLKGSLGELSERYPVSLDKPFDVFSCPGDITIVFTSRAFQPHAERFGSDYLFVGPSIASRQDPGSFPFAELEGETVILISMGTIFNQQKELYHMCIEALKDFDGKVVMSVGKSTDPRDLGSIPDHFIVRPYIPQLEVLKQADVFVTHGGMNSTNEGLYFDTPLIVIPMGADQFFVADQVERTGAGIKLDKNELSPAVLQKTIKDMLENRSYKDDAAKIGRSLRNAGGYQKAADAVLELAGRK

SEQ ID NO: 4689 - protein, 148 aa, Bacillus licheniformis
MPWSMEDYPASLKHLDKPVKKKAIEIANAMVDEGYDESRAIPIATSQAKEWADNRSKSELKSYAEKADETKRGDSGSSSRPELAEKCEHVIKHEKGWAVKAEDAKRASEVKDTKAEAVERAKEIAENKGTAVVVHKKDGSVERKIRMN

SEQ ID NO: 4690 - protein, 274 aa, Bacillus licheniformis
MRYDKTDLENELKKIEKWEKEQQKAWFWERIGRLPFKVLDKLTPAFIQDKIGLLLDEIGGFIQNGGQYLTSEKHLIRQFQKKLPDETIETIEDIQWAPLEVMDQICENLGKNRANTAAVQGATTGVGGLFTLAVDIPAILGLSLKTLQDIAVSYGYDPKEKTERMFIIKCLQLSAADIVGKRAIIQELSRYHQPSGSRENMISQIQGWREVVYTYRDSFGWKKLFQMVPVAGILFGAISNRSMVNGVAETGMMMYKKRRIMERLAELDATETEG

SEQ ID NO: 4691 - protein, 429 aa, Bacillus licheniformis
MQNQNGKASGLLPLFLFVCLFVGSGLITGDFYSLPIVAAALAASVVSLAMNRKEKLSQKTEWFAKGAGHPDIMIMVMIFILAGAFSSAAKAMGAVESTVNLALSFVPGQFMVAGLFIIAAFISVSMGTSTGTIAALAPIAAGISAEIGVPAAYSVAAVVGGAMFGDNLSFISDTTIAAVRTQKTKMSDKFKTNFLIVLPAAVATVILLMVFSAGGHPGAQAGTYSWVKVLPYLGVLIFALLGFNVMAVIFGGIVLAGVIGISDGSLTLHTYLTAITEGIGGMSELIILSLLIGGMAEMMKRNGGIAFLLQFVSRRIRSKKGAEAGIAGLVSAANLATANNTIAIITAGPLAKDLSDRYGIDNRKSASILDIFSCAVQGLIPYGAQMLSAAQIAKISPISILPYSFYPILIGVCGICAIIFRLPRFTEKA

SEQ ID NO: 4692 - protein, 238 aa, Bacillus licheniformis
MDRKTNLLELTKEVAEKHANFLVSEVNDHCMRIAVLEGEYVWHIHPGSDELFIVLEGELLIDFQDRPTEVLKANDSLLIPKGVIHRTRADVRSVNLCIEKTNAETVPFAEGNVLKLIRCKSAEQKLQAFSEAQAKWAPLQNVSGFIRQWGGWMETEDGPEAVVLALWKSKHDYLNFMAEHHDEIYERTHQKGTFESINITLFEDPAEISETLQNNTPAPVPEWTVMGSGRLRDPHSLS

SEQ ID NO: 4693 - protein, 146 aa, Bacillus licheniformis
MANNNDDNKMSREEAGRKGGEKTSQNHDKEFYQEIGQKGGEATSQNHDKEFYQEIGEKGGEATSRNHDKEFYQEIGEKGGEATSRNHDKEFYQEIGEKGGEATSKNHDKEFYQEIGKKGGEATSRNHDKEFYQENGEKGGRQRRSG

SEQ ID NO: 4694 - protein, 346 aa, Bacillus licheniformis
MAALIKFFQHPGVRRFSVFVVLAGVLYLFRSMMNLILLTFIFTFLMNRLENVIRGFLNRFIKVSQRLIISCLYAALAIALSIGGVVYYPVIVTQIQQLIKQGKHIASHPDSIPFLDMITGMFGDINLTSYLEKGLNFIYTYITDISTFGLQVVMSLVLSMFLLIEKDKVMSLMDKFKTSKIAIFYEEIAYFGKKFTRTFGKVLEAQFIIATINCALTTIALAIMGFPQLFGLAVMVFFLGLVPVAGVVLSLIPLSIIAYSIGGIAYIVSLVLVIMIVHAIEAYFLNPKLMSAKTELPIFFTFIVLIFSEHFIGIWGLIIGIPIFVFLLDILDVTNQEKNRTAGTRK

SEQ ID NO: 4695 - protein, 414 aa, Bacillus licheniformis
MKLATKIIIALLLGAVVGIILNVTSPDLFSKLNTFLFGPLGTIFLNLIKMLVVPIVFFSLTLGVAGLGDPKKLGRIGAKTISFFLITTAIAIIIGLVLALVIKPGTIGTYDTSAAEYSAQKAPSISDTLLNIIPTNPVQAMAEGNMLQIIAFSILVGLGITMLGKKADALLKVVEQGNDLMMYLVNLVMKFAPYGTFGLIAGAIGSQGWDAIKAMGLYMIVVILALFIHTIVTYGAAIALLAKRNPLTFFKDFSEGYACCLQYVQQQRDASGFDGCRSKKAESSRADLKLCPAARSYDQHGRNGDHARGATVFIAQVYGNDLSLTQLLMVVLTAVLASIGTAGVPGVGLIMLAMVLQTVGLPVEGIALILGIDRLLDMIRTAVNTTGDAACAVIVTETEKKHGKIEAPHSEVSV

SEQ ID NO: 4696 - protein, 308 aa, Bacillus licheniformis
MTKQPVLHIENVDKIIDGKTILKDIRLTADEGEIIGLLGPNGSGKTTLIKLITGLIKMKSGSIVINGFPIDRQFEKAIQSVGAIVENPEFYPYLTGYENLKHYANMHAGIGRERLEEVISRVGLEDAAEDKVKTYSLGMKQRLGIAQAILHRPKLLILDEPTNGLDPAGMKDFREHLRELAEEEGTAILFATHLLKEVEDLCDRVVILQKGKIKSTVVLNQADEKQEKAMLEVQPHDKALQWLKDQGYEARTEKGLLAVKVEKAQIPALNQQLVANDIDVYSIAPFKQSLEDEYMARTNGIEERNADV

SEQ ID NO: 4697 - protein, 257 aa, Bacillus licheniformis
MLMFKLIQNEHVKLLKRKVTFVSLALIVVFQFLLALITKRILMGAGAEDHFIGYFSFTPNLNILLQGLSIVVAASIISFEYDKKTIKFLLIRPVRREKILVSKYVTSVLASIWLFIIYYGFSILFGLLFFGVKLDEKAEPLFINTVKMIGTQWFEVWMMVSFAFLCSALFKSSALSIMVSIVVLYGAKMLVTIMAYLEKPLGKFLLFANTDLTQYAGEAKPLFAGMTPLFSLFIVFIHLVFFLGTAWWGFCKRDMKV

SEQ ID NO: 4698 - protein, 112 aa, Bacillus licheniformis
MKKFITALPIVLLLSFSFVSFAFNFDHLVYFRLALGLFSLAGLFLLYKLKNGVRLFMAYLYGSWIVLAGIAAYEEPLFSDFFFGGLTITMGYLTYMLIYLGMKVDRRGGQAV

SEQ ID NO: 4699 - protein, 382 aa, Bacillus licheniformis
MCSIFVKTERQQEWLDKIGKLADEFEKTAAYYDEHAQFPAEHIQKLRDSGYTALTVGKDYGGEGISLYDMLLFQERLAKGDGPTALSIGWHLSVMGELAEGNSWDRDVFSSLSHEALKGALINRAASEAQTGSPTRGGRPGTHAVKKNGGWIVNGRKTFTTMSPVLDYFLVTAWIEEKQMIGVFLIHKDAEGLAIEETWDMAAMRGTGSHDLVLTDVRLDESMLVELLAGKRTDKINGWLLHIPAVYLGIAQAARDYAVQFAKDYQPNSLKGPIKEVPAVQRHIGEIDLELMKARHFMYHVAELYDDPERRALLTGELGAVKHTVTNTAIDVVDKAMRVVGAKSLARTNPLQRFYRDVRAGLHNPPMDDATIAKLAGIAFSE

SEQ ID NO: 4700 - protein, 51 aa, Bacillus licheniformis
MSKRKIKTFHQLVEEYKKEIAKNPKEMEVIYDKIDRRHENRLLAISKAKQT

SEQ ID NO: 4701 - protein, 59 aa, Bacillus licheniformis
MAPQLKKAVEMRKKQLIQRLIQLGIYKKEERHLYELSLSELKANTNPSRKADKHVKTED

SEQ ID NO: 4702 - protein, 106 aa, Bacillus licheniformis
MKKITTEAQFNELIQSDKEIIVKFYADWCPDCTRMNMFIGDILEAYQENDWYELNKDDLPELADKYQVMGIPSLLIFKNGEKTGHLHSANAKTPEEVNEFLAEHIS

SEQ ID NO: 4703 - protein, 361 aa, Bacillus licheniformis
MKTRLGLVYGGKSAEHNVSLQTALAVTKALDTEKFDIHPIYITEKGEWVRGPQLTEPVSNVKMLQFEQTGQTFSPAVLNRDMFPGEADAKEDSIDVVFPLLHGPNGEDGTIQGMLELLNVPYVGNGVLASSAGMDKVVMKHLFAQAGLDQAKYVSFLKKTWSQSKEECYAQVEGELGYPCFVKPANLGSSVGISKCRSREELDQAFELAFQYDRKIVVEEGVIGREIELGVLGNDEPVCSVAGEIAPKKDFYDYKAKYEDGDTDLIIPASLTEDEYETMRSMAVKAFQAIDGSGLVRADFFLTNEGRVLINEVNTMPGFTPFSMFPLLWKQSGVEYAELIEKLVALAIERHEEKQQIKHTF

SEQ ID NO: 4704 - protein, 456 aa, Bacillus licheniformis
MITRTVKEIAEMSEGVLTNEAFEGRLIKGVSTDSRKLAKGQLFIPLAGERFNGHVFAEQAFQEGVAAVLWNRSEPNPPEGKPVILVDDTLEALQKLAKAYRNQLDVKVVGVTGSNGKTTTKDMIHAVLGTEYKVHKTEGNYNNHIGLPLTILAMPEDTEVAILEMGMSAKGEIDFLTRLARPDIAVITNIGESHLLELGSREGIAEAKLEIVNGLSKEGTLIYVGDEPLLTERLNQPPYDTKTFGEDPAFDYQLEDMTQTEEGTAFRVRGIENGFFIPVLGKHNVKNALAAIAAGDLLNVSRAHIAEGLTKLKVTGMRLELVKTPDGVAIINDAYNASPTSMKAAIELVEQMKGYGKKILVLGDMLELGEGEKAFHEEIGQAVNPDSIDFLFTYGELGAYIAKGALKHFPEHRVLHFNPEEKDSLKKTLKEKANTGDLILVKASRGMRLEDVIKDL

SEQ ID NO: 4705 - protein, 236 aa, Bacillus licheniformis
MIGCLCIHGFTGAPYELEPLASHLKQTADWQVEMITLPGHGEMPVLKGVCFQEWIACAEVELIRLLKTCDTVFLIGFSMGGMIAGYLAGKYPVSRLVLLSAAAQYISPGQLIQDLKNVIKDSLQGKLEDNLLYKRYKQKLTSTPVSSAFQFRKLVKMTKPALKNLRIPVLIVQGECDAIVPVSSAYYLYETIPSEEKELCLLPESKHHVCLEENSSILFQTVEAFLKKTPIESIKK

SEQ ID NO: 4706 - protein, 487 aa, Bacillus licheniformis
MTITFQDFQLSSDLTKAIKRMGFEEATPIQAQTIPLGLANKDVIGQAQTGTGKTAAFGIPLVEKINPESPNIQAIVIAPTRELAIQVSEELYKIGQDKRARVLPIYGGQDIGRQIRALKKNPHIIVGTPGRLLDHINRRTMRLQTVNTVVLDEADEMLNMGFIEDIESILSNVPAEHQTLLFSATMPAPIKRIAERFMTNPEHVKVKAKEMTVSNIQQFYLEVHERKKFDTLTRLLDIQSPELAIVFGRTKRRVDELTEALNLRGYTAEGIHGDLTQAKRMVALRKFKQGAIEVLVATDVAARGLDISGVTHVYNFDVPQDPESYVHRIGRTGRAGKTGMAMTFITPREKDMLRAIEQTTKRKMDRMKAPTLDEAIEGQQQVTVDRIRTIIEENNLNFYMTAAAELLEDHDSVTVVAAAIKMMTKEPDNTPVRLTEEAPLRTKRNKNHHHRSSKRRDGGGYRGKNNRSSYDKKRSSNDRRQKKSYNS

SEQ ID NO: 4707 - protein, 159 aa, Bacillus licheniformis
MRSEPKNQISRDGVKVWRITACITSFVLMLAAAGLIAAGVIFKWPVWIGILSAAVWLGISFVIIIMIPNIRHRVWRYEVHENEIDIQHGIFVVTRVIVPMVRVQHVDTSQGPILRKYNLASVQISTAATTHSIPALDVEEADQLRDSISRLARVTEDDV

SEQ ID NO: 4708 - protein, 492 aa, Bacillus licheniformis
MSEPRRMHPAAVILNFIKGLVETVKNFIIPFGVVIFLNQSQTVKMIAIAAAVLFFIALVVTSIIKWSKFTYRIEEDELRIEEGLINKKKRYIPIERIQTINTSAGLIQQMFKLVKLQVETASGGTEAEVSLVAITQAEAERIQQALFERKKAAEDTGTDVPVPLEETAEEAEEAEEPVMMYKMTGQELLTAASTSSGIGVIISGVFAFFTQVDDFFDLDWLYDRFAFLNSAGAAVIALAAFVALFIAWLLSIVGMLLKYANFTVVRKEKEIVISRGLIEKQQITIPLQRIQAIKIKESLIRQPFGLAAVTIVSAGGNVLEEDKSAILFPIISKKIINQRLGEFIPDYAPEDDLNRLPKRALRRYILRASWPVLAVVPLSILFPPWGYLSAVLIPFYWIIGYFSYRDAGWKISGSKIIMSSRFIGRTTAVIQRRRMQVFEVSRSYFQRRKQLVSIHTSTKSSVLMEKFSVADVEEKDSDDIIAWYSYEKRVNG

SEQ ID NO: 4709 - protein, 199 aa, Bacillus licheniformis
MFIRTENFQTFIRLYPVTSAILALQLAIWILFLFPFTAVQMWSDLLIGFNWGIANGEWWRFVTPIFIHAGFGHLLFNSMSIFLFAPGLERMLGKLKFLIVYIGAGVIGNIGTYFIEPLEYMHVGASGAIFGLFGVYLYIVLFRKELMGSANSQIIVTILAISVLMTFVNQNINMMAHIFGLLGGLALAPPLLNKRVNGF

SEQ ID NO: 4710 - protein, 322 aa, Bacillus licheniformis
MRKSFVLLLTGLLVILMLSACGQKSQEDVVTGLDKKAKEYTSYKAKAKMTIETGNEPQEYNVEIWHKKPSLYRVYLENPKKDQSQVILRNENGVFVLTPSLNKSFRFHSDWPNNSSQVYLFESLVKDVKNDGEASFSAKDSKYIFETKTNYQHNQMLPTQEIVFHKKTMAPSSVKVMDTDRKPMVKVEFTSFEFDKPLDKDSFDEKKNMTLSQIDVATSADVSDSFAVKTPLDVPQGVKKLEEKEMATEDGKRIVITYGGEKSFTLIQEKARVAKTSTSVSMNGEPVDLGFTVGALTDKSLSWTYDGVDTLSHQKIFLKMNF

SEQ ID NO: 4711 - protein, 395 aa, Bacillus licheniformis
MKQGTGSVMMSLKPFYRKTWAEIDLTALKENVRNMKRHIGEHVRLMAVVKANAYGHGDAQVAKAALAEGASILAVALLDEALSLRAQGIEEPILVLGAVPTEYASIAAEKRIIVTGYSVGWLKDVLGFLNEAEAPLEYHLKIDTGMGRLGCKTEEEIKEMMEMTESNDKLNCTGVFTHFATADEKDTDYFNMQLDRFKELISPLPLDRLMVHSSNSAAGLRFREQLFNAVRFGIGMYGLAPSTEIKDELPFRLREVFSLHTELTHVKKIKKGESVSYGATYTAQRDEWIGTVPVGYADGWLRRLAGTEVLIDGKRQKIAGRICMDQFMISLAEEYPVGTKVTLIGKQKDEWISVDEIAQNLQTINYEITCMISSRVPRMFLENGSIMEIRKSDLA

SEQ ID NO: 4712 - protein, 80 aa, Bacillus licheniformis
MAESRATTGILIPLAETLISKLDGGLLPDNRSQNGLVYPATKMDFPQPQNPPIPESMKPRYMENGQNHLDISSEGSFCRV

SEQ ID NO: 4713 - protein, 116 aa, Bacillus licheniformis
MIVKRGDVYFADLSPVVGSEQGGVRPVLVIQNNIGNRFSPTAIVAAITAQIQKAKLPTHVEIDAKRYGFERDSVILLEQIRTIDKQRLTDKITHLDDEMMEKVNEALQISLALIDF

SEQ ID NO: 4714 - protein, 275 aa, Bacillus licheniformis
MSNQAVLKFISEHQNVLAGNLADILKDLNSNMTNVKLTEHMYETISNEYIHILMNESGDGNEKSIDTIYQFSSKAVQLGVPLKLLSSGLSAFWKHLYYEMNKDVPEDQQCYDLIWEIDKFIEPINSEILNQYAISWEKTVALQKVALQELSAPLIPVFENITVMPLVGTIDTERAKKIMENLLSGVVKHRSEVVLIDITGVPVVDTMVAHHIMQASEAVRLVGAKCLLVGIRPEIAQTIVNLGIDLTQVITKNTLQKGIQTALEMTDRKIVSLEE

SEQ ID NO: 4715 - protein, 121 aa, Bacillus licheniformis
MRVPNIPILKLYNCLLVSIQVELDDQTALKFQEDLLNKIYETGSNGVVIDLTSVDIIDSFIAKVLGDVITMSKLMGAKVVLTGIQPAVAVTLIELGISLDEIETALDLEKGLETLQRELGE

SEQ ID NO: 4716 - protein, 133 aa, Bacillus licheniformis
MADQSCVKILTEWDIVAARQLGRNVAKELGFGTVDQARITTAISELARNIYLYAGKGRICIEQVQEEGKKGLKIVAEDEGPGIADIKKVMEDGFSTSGGLGAGLPGVKRLMDQFELHSDAENGTDIQAVKWLR

SEQ ID NO: 4717 - protein, 335 aa, Bacillus licheniformis
MDFREVIEQRYRQLLSRYISELTETSLYQGQKFSRKTIEHQVPPEEIISIHRKVLSELYPDLPDHVFHSLDFLIEVMIGYGLAYQEHQTLRGIQQEIKSEIEIAANVQQTLLETTVPKVEALEIGAVSIPAKQMSGDYYHFVRDKESINIAIADVIGKGIPAALCMSMIKYAMDSLPDSGTSPSQVLKNLNRVVEQNVDPSMFITMFYGNYHLQKHLFTFSSAGHEPGFYYSCRENKFYDLNAKGLVLGISSNYDYEQYEQKLDIGDMIVLFSDGVTECRTDSGFLERSDLQNLITVHMEKPAQQMVDNIYEHLLKLQDFQLHDDFTLIVLKRKV

SEQ ID NO: 4718 - protein, 106 aa, Bacillus licheniformis
MAVDTNKNDHVIEVKVAGEIDVHTAPTLRDELMPLAEEGKDLKVSLKDVSYMDSTGLGVFVGIYKAVNRTGGSLVLENLSERLIRLFDITGLKDIIDISGKSEGGL

SEQ ID NO: 4719 - protein, 161 aa, Bacillus licheniformis
MKRAADYIEMKSPAKPEYVGIIRLTLSGIASKMGYSYDDIEDLKIAVSEACTNAVQHAYKADNNTGEVSVRFGVFEDRLEIVVADQGDSFDIQDKQKELGPYSPEHTVDQLSEGGLGLYLMETLMDEVHVQIDSGVTVSMTKFLNRERVDDGTTVQNYETN

SEQ ID NO: 4720 - protein, 263 aa, Bacillus licheniformis
MAQPSKTTKLTKTEVDTLIKKYQENQDEDAQLTLVQTYKNLVETLAKKYSKGKSFHEDLCQVGMLGLLGAIKRYDPDVGKSFEAFAIPTIIGEIKRFLRDKTWSVHVPRRIKELGPRIKMAVDHLTTETQRSPRVDEIAEFLDVTEEEVLETMEMGKSYQALSVDHSIEADADGSTVTILDIVGSQEEGYEKVNQKLMLESVLHVLSDREKQIIELTYIQNKSQKETGEMLGISQMHVSRLQRKAVKRLREALAEDPYMELKP

SEQ ID NO: 4721 - protein, 199 aa, Bacillus licheniformis
MIWTESNEHMQALVYQLPKEGKAVCGDSFYFHATDETMVCALADGLGSGALARESSSVISEVVEEHGHEDVESLMERCNQALKHKRGATVSILKVDFRTRTIAYSSVGNIRFILYAPSDKYIHPLPVTGYMSGKPQTYKTFTYTYEKGSRFIIYSDGLEVPALRTYLKQHHTPGDISNQLESYTRMGKDDLTYIIGQLF

SEQ ID NO: 4722 - protein, 724 aa, Bacillus licheniformis
MEATMDTLASIVKQIAKETGLAPKHVESVIQLLEDGNTVPFIARYRKEQTGSMDEVQIQTISERWGYIQHLNQRKDEVIRLIDEQGKLTGQLKLDIEKADKLQEVEDLYRPFKQKRKTKATIAKSKGLEPLADFIISLPRNEDVAAEARKYINEEKEVMSAEEALEGAKNILAERISDEPEYRKWIRQETFKRGTLKSAAKDAEADEKKIYEMYYEYEEPIQKIVPHRVLAVNRGEKEEILRASVEPPADRIQAYLEKRILQQKQTSAQDVLKSAIEDGYKRLIQPSIEREIRKELTEKAEDQAIHIFAENLRKLLLQPPMKGKLVLGVDPAFRTGCKLAVVDETGKMLKIDVIYPHPPVNKKSAAIEKVKRIIEDFQIEVIAIGNGTASRETEQFIADLLKDIDRKVYYLIVNEAGASVYSASELAREEFPDLQVEERSAVSIARRLQDPLAELVKIDPKSVGVGQYQHDVSQKKLNDSLRFVVETVVNQVGVNVNTASAALLQYVAGLSKTVAANIVKKRDEIGKFTSRKELKDIPRLGAKTYEQCIGFLRVPDGDEPLDRTGIHPESYKETRELLKKLGLSTAQIGTKELQDKINELNISEAAEQLGIGEITLKDICAQLTRPERDPRDEVPKPLLKTDVLQLEDLKEGMELQGTVRNVVDFGAFVDIGVKQDGLVHISKLSHSFVKHPLDVVSVGDIVTVWVEDVDAAKGRVSLSMVKDR

SEQ ID NO: 4723 - protein, 185 aa, Bacillus licheniformis
MEDRRSIKTKRAIKEAFLKLLHEKEINKITVSDLSRRADLGRGTFYLHYRDVFDLYEQIENELFDQLGKFYDDYFPSEDPHHLLTFIEKTTEYIYQNAAIFTLLTKPKGNILTINKFKDFFKQKIFEELSMMQQSGNEMACDEMEITFLVSGAVGIFEEWINGGMVQTPAHIAGVVHRILLKIAM

SEQ ID NO: 4724 - protein, 1039 aa, Bacillus licheniformis
MRTIIKARWIIAALWIAMAAVLFITAPDMGQLTKEKGQIAVPEGYPSSYANKLLEQMSKDGDTNKSVVVVFQDKHLLPNREAALKKAITTLEKDSSLHVSDITSYFNADEDIQKQLLSKDRTTLLVPVTFDANKISAAEFKAKVNEKLKTLKLDYEMTGQPLIDDDVMTSSQEGLKKTEYITVGFILIVLILVFRSAVAPFVPLLAVALSYLVSQSVVAYLVKYADFPLSTFTQIFMVAIMFGIGTDYCILLLSRFKEEIARGKDKIEAILTTYKTAGRTVLFSGIAVLIGFTCIGFAEFQLYKSAVAVAVGVAVLILALLSIVPFFMAVLGKVLFWPVRGNIGHPQSKLWETAGRFAFSKPLISLLIVAAVAVPPILMYKGTLSYNSLDEIGDQYESVSAFNTISDKFGPGESLPVTVVLKTSDALDTNDGLIAIEKISRAIEQTNGVSKVRSATRPVGKGLSDLYVKTQANELNKGLESGNKGLKKIKDGLAEASKSIADQKPQIEASGKGINQLIKGTESIQAGISDVEANMRKLKEGTDQSKQGVAQAKKEIQTAKKQLTAQVDQLNGQIETYKEISKILKAALSQAENAQGITADVQKMIEQTNQNFKNLESEIPEVKENPSYLAIKGSYTELASAIKQGSQKAAVYTKQAANAKKQLEAADAFIAKAQEEQKVYTSKIDALINGLGQIEKGLEETSKGQGQLADSLPKLESGAGEVAEGQKQMKEKVGEFAGQLDQLTKGLNSSVDGLEKISSGLMGAGDYLDQLKNASDQEMSGWFVPKEVLKNKQFQQVFNSYMSDDRHITTIDVILEDNPYGNGAIAKVKDIEASVKRALPDTHLHDASFGVGGVSSINADLKQLSDQDFSNTVIYMMIGIFLILVLLFRSIVMPVYLVGSLVLTYFASIGVTEFIFTAFFGYPGLNWAVPFFGFVILMALGVDYSIFLMERFNEYRGTDIMTAMTESMKNMGSVIISAAVILAGTFAAMLPSGVLSLLQIATLVLTGLLLYAFVMLPLFVPVMVRIFGSANWFPFKRKE

SEQ ID NO: 4725 - protein, 36 aa, Bacillus licheniformis
MPNWLKNQMQRAFYEKDHYQIKLLNQCWYFYRKKHC

SEQ ID NO: 4726 - protein, 153 aa, Bacillus licheniformis
MDEQQLQQLTEQLSLTYFKKPFRHRAYFNSRLKTTGGRYLLNSHNIELNKKYLTEHGQKELEGIIKHELCHYHLHLEGKGYKHRDKDFRTLLKEVGAPRFCTPLEKEKKPQRKVRTYKCEACGQTFLRKRKMDTSRYVCGKCGGKIKEIIKKG

SEQ ID NO: 4727 - protein, 304 aa, Bacillus licheniformis
MPIIIGGNKKMKNTLLGSIYLALAASIWGGMYVVVKVVVAVIPPIELVWIRYVIAILTLLIVGLIKRQSWKIHKRDLLLIVVIGIVGNTISIVTQEYGTMLSSAQMGAIITSSTPAFMVIFARLLLKEPLNIKKGTSIILATIGVLFIVGNGHIDTSNQIGGISLLAAALTWALMSVLIKLVPNSYSSLLVTTYSTFVAIVALTPFVKPTAIFTSQLLDPKILGGLLYLGIVSTACAFLLWNRGLQLLNASSGGLFFFFQPLVGTLLGWLLLGEKIGGTFWIGSFLILIGVLLVIKEKEKDVNS

SEQ ID NO: 4728 - protein, 137 aa, Bacillus licheniformis
MISKFFSGIHNTIFSPLRSWAEQSPGNWNILIVVGFLLVYGSGILVYVFYKKLGKDDERTNKIYLKSSSYMLLVIILCDMIFPKDDMWTIFFLYKYALAFLAAGIYLSVQYKKDFHKKGRGVILSHGRRIRQYLLTD

SEQ ID NO: 4729 - protein, 81 aa, Bacillus licheniformis
MVVKKDFGDSISNKVYEYRVLARMSQQELAEKVGVSKQTIFVMEKGNYVPTLLLAFRIAEFFNVDVNEIFTYVKGNDQNDK

SEQ ID NO: 4730 - protein, 342 aa, Bacillus licheniformis
MNDQNLKTLRKLVTPYEKSDLQKSIYQIINTLIPFFLLWCLAYKSLSISYFLTLAISIVAAGFLVRTFIIFHDCCHYSFFKNKKANRILGTITGILTLHPFDHWGRDHSIHHATSSNLDKRGTGDIWLLTVEEYKEASTKTKIMYRLYRNPFVMFMIGPIYVFGITNRFNRKGAKRKERMNTYVTNLGIAALTALLCWAIGWQNFLLVQAPIFMISGSLGIWMFYIQHTFEDSYFEEDEHWEYVKAAVEGSSFYKLPKVMQWLTGNIGFHHVHHLSPRVPNYKLEEVHNNIEPLQNVPTITLATSLKSLKFRLWDEESKKFVGFSHLKKASKSQVSAQLRTD

SEQ ID NO: 4731 - protein, 67 aa, Bacillus licheniformis
MEQGTVKWFNAEKGFGFIERENGDDVFVHFSAIQSDGFKSLDEGQKVTFDVEQGPRGAQAANVQKTA

SEQ ID NO: 4732 - protein, 328 aa, Bacillus licheniformis
MNNVSLIYKEFGDPLQKLQLHAGEKLPLQPNEILVKMIASPINPSDLLPIRGAYSHRIKLPAVAGYDGVGIVIDQGKDVSPSLIGKRVLPVRGEGTWQQYVTTKADYAIELPPSISDNDASQLYINPLTAWLICTESLRVQPNEIVLMNGGGTSIAGLFAQISKILGFRLIVMTRNSRKIEKLQKLGAWRAIDASKGSIYEKISDGCDIGVDHAIDSVGGESGELLARALKPEGTFVSYGLLSGIPNDWRKLHDVYHVSPQLFALRLWNERHSVSEYRNRFSEVIKLVESGRMVINAPEKIYDFEDFYDALKHYEQPGLNGKILLNFA

SEQ ID NO: 4733 - protein, 201 aa, Bacillus licheniformis
MKYLFYVIGILILTLGIAFTIQSDLGASPFDALLVVLAVHAGLTVGSWEVIIALLLIGCNSVLKRQRPEVSGLLTAFITGIGIDMWLFLLHFFVTPEQWYSKAVCFGIGLVVTGLGTATYLYTNFASMPIDRLTFIIKELTGTNIFFSRTIIYLVFLTAAVMLKGPIGIGTLLTVCLGGLALHLFMPFAGKVLGRFTDART

SEQ ID NO: 4734 - protein, 150 aa, Bacillus licheniformis
MKDILREIGMIARALDSISNIEFKEHDLTKGQYLYLVRICENPGIIQEKLAEMIKVDRTTAARAIKKLEMKGFIERRDDEHNKKIKKLFPTEKGNEVFPFIKRENDHSNRVALEGFSEGEAEIIFNLLQRVRKNVEKDWEFVKKGNKRNY

SEQ ID NO: 4735 - protein, 172 aa, Bacillus licheniformis
MTVNIKRCTLEDLHKLQEIGYETFNETFKHQNSPENMKAYLDKAFNLKQLEKELSNSSSQFFFVYFNNEIAGYLKVNTDEAQSEKMGDESLEIERIYIKNNFQKHGLGKYLFNKAVEIAKELNKKKIWLGVWEKNENAIAFYKKMGFVQTGAHSFYMGDEEQTDFIMAKTIL

SEQ ID NO: 4736 - protein, 205 aa, Bacillus licheniformis
MYIPKYFKVENADEILDFVQKNSFGTIVTTEQGKPIATHLPLGLNKKGDDYYITGHIAYGNPQVGTLETCKDVLVMFQGPHAYISSSWYGHEDVPTWNYQAVHIYGKASILERDELIEELTIMMEKYEKHRENPILWDNLSPQLLERQLKAIVGFKIKVEDIQAAYKLSQNRNDTDYMNIIDQLQNEGDPDSEQLAAAMKKRLEN

SEQ ID NO: 4737 - protein, 304 aa, Bacillus licheniformis
MAKKTIRLLMPQWQGGNNPNYSFGAELLAWLAPENDQPLIHVPVQPYDGTPLENENGINGRKQLLEQLEAAQHIIHAHKPDRIVMFGGDCLVEQAPFAYLNERYGGDLGLIWIDAHSDLVRYAGYDNGHTLPLGNLLGEGDEEFAKHVKIPLKPENVFIAGLAAPTEEETKVISNELQRQGIAPTEPDTEVIQRLGIRTAGTKKLMTSTEPIKEWIKESNIKYLAIHLDLDVLDPKAFRSLLFANPEAPVNFSPEGTMQMPYLLHLLKELSSETDVVGLGITEHLPWDSIHLKKLLSEIPILTQ

SEQ ID NO: 4738 - protein, 133 aa, Bacillus licheniformis
MNANKKIVRTLMTGTIQKESVKMSMAEYKGKVKNIQDTPFGYTLSVIGGKWKMVIIYLLAENQPIRFNELKRQIGAITYKTLSSQLKELEADGLVKRKEYPQVPPKVEYSLTDKAESLLPVLEGLCEWGLKNQ

SEQ ID NO: 4739 - protein, 290 aa, Bacillus licheniformis
MNKIEKHRKFRAKMIFKVIMVMIGGIIAAYGLETVLIPNSVSDGGVTGLSIVGSQLFDLPLGILIAVLNIPFVWLGYKQIGKSFALLSIIGIASLAAGTSFMHHTPAIIEGDTLLVTVVGGIILGFGMGLALRNGGALDGIDMLAVLLSRKLPFGTSDLILFFNLFVFIFVSAVFGLQGALLSVIAYYIASKVIHVVEEGLSGSKTFQIITSEPELMVETIRDQLGRSATYKEAYGGFSHEKFKEITCVINRLEDTKLKEIINEVDKNAFVTVYDVAEVKGSNFRKPNIH

SEQ ID NO: 4740 - protein, 192 aa, Bacillus licheniformis
MSIIAFLSYVIMTSITPGPSNILMMNEAQRFGFTGSWRFSSGILAGFAVLGILSGAFTISLYNWIPVVEPYFKLAGACYLIYLALQVGFTKNKKQDSTEARSSFISGFIFQLINIKSILFFLTVMSAFVLPFNHSLKSTIYYLALAIVLGWLALLLWSGFGSVFKRVFAKHDRVFRVLMCLLLMYSAVSIFR

SEQ ID NO: 4741 - protein, 293 aa, Bacillus licheniformis
MEIRHLITFQTIVEMGSYTGAASKLGYTQSTITTHIQALEHEIGGALFTYEKRNLKLTQLGRELMPLAEELLSTHNQIKNLQSAHEVKGVLKVAAPESLTISRLGPIIREYSLKYPHVKLKLSNGTCGQNQVDLLSGNVDVALMVYPEIELDKCIRYTLAEEKIVLVGSSEGPEDLEEYQKHFFITNEEDCSYRTMFEKYLLKNDIHYFPTMELWSIEAIKQTVMSGLGFSVLPYITVKDEVESGKLKILPHSQYLDPLYSQMLIKKKKWQLPAVDAFADLVLHSFREPRLIG

SEQ ID NO: 4742 - protein, 73 aa, Bacillus licheniformis
MREFAPKVFQTTGIIGFILAFVQIPIGWFIGFFFSGLFFMMLKSNNEKSGTFNMMAGIACLLYSFYCLFTQVL

SEQ ID NO: 4743 - protein, 408 aa, Bacillus licheniformis
MRKLKLLLAANLISTVGTGITSYLIVWLLIDQLKQSVLYGLLTMATMILVFFASPYLGSLVDRYSRKAIFLYMEITGIVVLGVFSVLCNVSAVLDITLVVMLIFYHTAYDSIKYPALAALTQEMFKKEDYSKVNSSLEVQGQAALMISSGLAAMMIGKMDAAVILVMNISTFIAASILIYQLPYQRNAEAEEHSNTMKNESYWKNFRSSLQYLCYRKVLFVLLLTSFIPSIVIIVANYLDPVFIYDYLNEGPSVIGIANIVYAIGAMGAGFVAYQISKKWSDMQGVILFMAVFALATIAIFLVPNAVTFIVASLFWGHSNAAIRVFRKSYMFHHVDNAYMGRVNSLFNAVKLLGQVALIGILTITVVPAGQTVYGYFVLFIIVIAALLTTTYLFNRTYNKDKEKRVSL

SEQ ID NO: 4744 - protein, 260 aa, Bacillus licheniformis
MKINQIVDLSVSLRGDIPSDPPGFIPEIEYADHKQGAKQMVQSFPGLSSQDLPGGEGWSLEKVKMSTHAGTHIDAPYHYRSVTDDGKRMMTIDEVPLDWFHGPGVKLDFRHLKDGHIVTPEEIEQELHRINHKLAPGDIVLVNTSAGAKYGQSDYLDSGCGMGREATLFLTERGVRLVGTDAWSWDAPFSMTAKRFEQEKDPSIIWEGHYSGSTIPYCQIEKLANLDQLPSTGFYVMAFPVKVEKASAGWARPVAILSGE

SEQ ID NO: 4745 - protein, 460 aa, Bacillus licheniformis
MTEDVTDNDIHEQKLSRGLKNRHIQLIAIGGAIGTGLFLGSGKSIHFAGPSILFAYLITGIICFFIMRSLGELLLSNLEYHSFVDFVRDYLGDMAAFITGWTYWFCWISLAMADLTAVGLYTQYWLPDVPQWLPGLIALIILLIMNLATVKLFGELEFWFALIKVIAILALIAIGLFMIFKGFSTHSGTAAFHNLWSHGGMFPNGLHGFLLSFQMVVFAFVGIELVGLTAGETKDPEKVIPKAINNIPVRVLLFYIGALLVIMSIYPWNVINPNESPFVQVFAAVGIIAAASIINFVVLTSAASASNSAVFSTSRMIYSLAKEHNAPGAMTKLTSRKVPGNALFFSAVVILIGIMLNYIMPEQVFTLITSISTICFIFIWGITVICHLKYRRTRPDLAKRNKFKMPLYPFSNYVVLGFLAFILIVLALAQDTRVSLFVTPVWFIMLIAIYKLRKPKSRQV

SEQ ID NO: 4746 - protein, 166 aa, Bacillus licheniformis
MYVHVIAACLAMVSGAVNFSSGLLAKSRKIHRLNGFIYVVSVMVVTLSSGYMAPHSTGGRAVSIAFNMVNMYWPAATVISVIKARRNQFTKHRNWMIRSYLFCFTNLFIHFITFVCRSGFGLPYDISYTIGVYGAIALNVAAAEFVIHFTRRKAVDILHTAGFDKV

SEQ ID NO: 4747 - protein, 211 aa, Bacillus licheniformis
MDDRIETKEPMPSLIGLITNPALQFERMKRRPAVALPMFIVFVLSVLSAYLYISKDFPDTYTYFGMIIFLWEFLKTGIYLFVSALILWLIATIGGGKTNFVTMFSLASFVGFAKIIGDVINNTVYRFANVPEGTSFTSLHDVFSAVEPYKSILGVFDIFMVWALVLAAEGLQKAGGASKRASWIAVAVLFILKFLFACFFGLFAALFEDIF

SEQ ID NO: 4748 - protein, 165 aa, Bacillus licheniformis
MKKQAARASLVACITDRKEDFYRLAYSYVKNQEDALDIVQESIKKALDSVDSVRNPDTIKSWFYKILVRTAIDFLRKQKKLKVMDDQTIEFLSQGKEDTYRDTDLHEALDELPQPYHTIIVLRFFEDLKLEEIAEITGENLNTIKTRLYRGLKLMRIQLTKEDLS

SEQ ID NO: 4749 - protein, 286 aa, Bacillus licheniformis
MDKKLEQLRKAYQNVPIPKELDQVVETALQHKPKKKRRIVVWPASTLVAAAVLLAAVVNINPGAAQAMSQIPVIGKVVKAITFTEIKQKDGESSIDVKTPALSGLNNRELENGINEKYVKESHQLYREFMKETSRNKKGHLSIYSDYETVTDTKDLISIRRSVERTEASSYTERRYITIDKKNEVLLTLKSLFKDDRYITAISENIKEQMKQQMKDDPDKIYWIGDEEVEPFKRIKADQNFYITENHKLVISFDDYEVAPGYMGAVEFEIPTKAISNLLIGDRYIR

SEQ ID NO: 4750 - protein, 626 aa, Bacillus licheniformis
MRDQTQQHRYIPGLDGLRAFAVLAVIAYHLNMSWADGGFIGVDIFFVLSGYLITSIILPAYGNDISLTFRDFWVRRIRRLLPAATLMIFATVIWVALFNRELMHTVRGDAISSLLYVSNWWFIFHDLSYFDSFGSPSPLKNLWSLAIEEQFYFIWPIILLLGIYIFKKRERFAAAVVLCALCSAIWMSILYVPGGDPSRVYYGTDTRAFELLIGCALALVWPMKRLSGNRLPNSLKHALHGTELAAFALLMMCIYFVDEFSPFLYHGGMLIISIIAAILIACVSHPSSFLGFALSVKPLRWIGKRSYGIYLWHYPVIVLSTPVQEIGNPVYWHVAMKVAVTFILAELSYRFIEKPIRKDGFKPFVSRVFLDKITEWKTASVPSKISIGLMFAALLVFAGGLSGLADEKKQPQQAYSKSYEETSASADQPADKSEERQDDKKAQTESGNESKTGNGEESSDTKDEQSAEKEPDRIEKEVLAVGDSVMLDIASSLRRKIPGITIDGQVGRQVREALQLTSTYASFNHPDKAVVIELGTNGYFTDGQLDALLDAFSKADVYLVNTRVPRQWESKVNESLRKHADSRQNVTLVDWHAEALQHPEYFTADGVHLMPKGAEALASLIVKAMK

SEQ ID NO: 4751 - protein, 391 aa, Bacillus licheniformis
MALAFLLGMLAILGPLNIDMYLPSFPEIADDLGAGASLVQLSLTACLIGLTIGQLVIGPVSDAKGRRKPLLISISLFALSSLFCALSPNIATLVLARFLQGFTASAGIVLSRAIVRDVFTGRELSKFFSLLMVITAVAPMVAPMTGGAILLLPFATWHTIFYTLALIGLLLVLVISMKLTETLPPEKRIPSSIGSSLKTMGSLLKDRSFIGYALTVGFIHGGSFAYVSGTPFVYQDIYGVSPQVFSVLFGINGLAIISGSFIIGRFGGIIHERKLLRIAVITAVIATSVLLTMTILKGPLAAIVISIFIYMITIGMTLTSTFTLAMENQGHRAGSASAMLGMLPLLLGSIVSPLVGMNETTAVPMGAIMFITAVIGSFAFFALTRENQGER

SEQ ID NO: 4752 - protein, 1030 aa, Bacillus licheniformis
MKKLFVFISIILGYAGFFFIFLFINNQLSEQNYPEAKQGIINLETWDFQKDGNIALTGEWALYRNQLLSPKDIHAGKGKAPIYSDVPNNVKLTDSGKNVDYGTYRLMIRSKQDNEMFGISTSFINSANRVYFNGKLIGQSGTPSNKANFTAQNRPYTSFFEVRRGDNELIVQFSNFKKTPSWGIEKPIAFGMQQHILHQSKISFLNETSMITAFFITGLYFLGFFLHRRKDKHLFFFSTMCLLFSVIVLLIGRERMIFLLFPSISFSALSVVRATTMVLVSMAVFLYLYFAYKEIVSKKWIIAATAFSVLVLMIDFITWGYTDRLAYILHSVLAVTTLIYITYVFAISAVRKMKGSLYLTIAAISMSAFVILTTVSAYSGKRGFSFNSLYAVPSIIALLAAVLMMAQQFAGAFRENEILSLKLLRMNRLKDEFIAKTSHEFKTPLNSMINICQTLLARKRKRTLEEEKENLQLVIRMGYRLSSLVNDILDLEKMKQGMLQIQAVPVDAHSAISTEMDFYRLLSKNKNVRIVNRVPSGLPLVLADENRFRQIMTNLVDNAIKYTPEGQITLSAERLDQEKVKITVADTGVGIPKAVRQLIFEAFQQAKNHKDDGAGLGLSIVRQLVQLQNGEIWVESEEGKGSAFHFTLPVAKNDPLPDAKKENMPQQQAVRDLPDVSISTPYYSKKMDASTVLIVDDNIESLKILADMLEGVPYQVIAAKSGHEALEVVSRSKLDLVILDLMMPDMTGFEVCMKIRERFTMVELPVLIITAAIIDHDKYKAFHAGANDILQKPYNYTEFAARVKNLIMMKDTAAQATNMEMAFLQSQIKPHFLFNVLNTIIALSHLDIEKAREVTADFTNYLRMSFDFQNTSGMSSFKHELSIVNSYLSIEKTRFGDRLDVIYDIEEDIDFTLPPLMIQPLVENAVHHGISKKRGGGWIKLTAKKESENRYYIKIEDNGIGMPPEKQQDIFSSHFTHSVGMKNINRRLKHFCGSELNIESTPDSGTAVSMVISINESADVSDSAIQRAPL

SEQ ID NO: 4753 - protein, 358 aa, Bacillus licheniformis
MKALIVDDEELALLHFKNMLERTNCFRFIEMFQDPADVLEYPDIRDIDTVFLDIEMPGINGIELAEAIQSMNENIQVVFITAYNDFAIKAFELNAVDYLLKPVDYVRLVKTIERIRENSLLKASAVNTGGDYFIQCFGNLQFYKAEKGVKTYIPVKWRTSKAREIYAYLLHHHGHVISKDVLIDLFWQDHDVSKASTQLYSAIYQIRKLIDRLPFGQSIEKTDTGYVLRISGVKVDADEWEKSLKEAPPIHMATINRHMELLLAYENHYFMEHGYLWAEPEKTRLARIWLGKAYELVDFLIHEKDYRRGLDICLLVEKIEPCDHKIIQYKMQLFNKTGNVEEAIKEYERYKLMKDKMN

SEQ ID NO: 4754 - protein, 1975 aa, Bacillus licheniformis
MRSKKYSFSLSKKRGLKSFLVTCLALYLIFSQVVGFTLTAVAAGTSTGGSVFFDSVTIKNSEDQTVDGSKGDEPALKPGDKVTLTYEWSLKNDEEAGAENSFTVEVPKSFEFAQDAEGEVKSADQQIIGSYQVKADSNIFTVTLKSPAEGSAGAKGAIALSAKFAADMKSDTKTVTALFQLGAGKTQQVIIPVNTGSESETAKNDPPSSEDDQSDDQSKSSGGQDQEETKKKAADAENSDSKPAASSRLAAAGSLASGGNQITQNILTGVTLTDEHGKPYDKSNRADTNSPAKISITWDIPNELGKTINDGDRYEFDLPEAFIMYNDITNQPLSSDGITYGYFSIDTKGHVVMTFNGEVKEDSNVKGTLFVNTQFNAQKIKGSTTQKIPFPVKSDTPEVTVYFKPKVSKTIDKSGTFDKGINPGQVTWTVDLNKKLDQVKNAKLQNFPEGLTYRSVKVYQLDVNIDGSVSRGDEVLSGYTVDADGNVTFDGEIDSAYRLIYVTDIDDSAKPNEGGNAAFRNKATFGGDNLEPASAEASVTAKYGKMIEKSSTGYKSDSQTFSWTILYNYGEKKIDESKASITDSFGSADLHLVSDSLKVIPITFNQNGSEQAGTPLTEGKDYTLSDNGSGFEIKFNQDVTGAYKITYQTEVNSGVIIDKSTTYTNTAVTGTGESKKASGTAVQQNLIKGYSNIDYKKKTVDWTIAINKNNYTMNNWKLDDNFESGGLTLLDGSFRLQDVTNNKTLEEGKDYTLIIKPDHEGFLLELIGDYATTNSQLKITYTTNMNADFSNENVKNTAESTWTDHSSTERKNKEASSFTPNRQTSHNGFKHGLYNAVSKEITWKIGINYNGEPSKNPYIKDSLADDQQFEKGSVVVKSYSVNKDGSITEGDILPASQYDVEEPSAANKQTLTVHLKTDDSVPYLIEFKTSLKGQVIKHDPYTNKATYHNAGYSERELTASVSVADGGSLVFKGGKQNGGYVDWSINVNASQSVLEDVKVTDTPDTNQILAEDSFKVYQAKYDEKGAVKDSSGNLVPDDVQLKKGEDYTLDIKTDNATGEQSFVLKFTGDYKKIDRAYVIQYQSLINIAGTSGHVNNKVSISGTNVQEQTQENNSSVFVAVSSGGGSGSGERGSLTILKTGEDGTPLSGADFQLRTKDNEQLLRTGTTDDNGKLTFGNIRYGTYILKEIKAPDGYTISDAYADGVSVEINSSSSSAGALYKVVNEKNKVTLIKQDEQKNPLEGAVFKLEKKSGDGAFTTIRTNIKSDKNGKVEINGLPPGDYRLLETKAPEGYLLNTKELGFSVKTNDKNQVPDVDLGTLINYKGRAHLTKEDAEGRQLEGAEFKLIDHEGKTIHEKLTSDQDGKTAVSDLAPGRYAFVETKAPEGYVINSKAIEFTISESAKEKPESVDAGKAVNYKGSVYLTKEDAEGRTLKGAEFKIVDHEGKTVHEKLTSDEDGKIAVSGLAPGRYAFVETKAPEGFMLNNDQIEFTIPGSAEGKPEPVDAGAAVNYKGSVHLTKEDAKGHKLEGAVFKIADQIGNTVQEELVSDRNGTVTASGLAPGRYAFVETKAPDGFVLNSGKIEFVIPDSAKGKPEHVDAGTFVNYKGSVYLEKKDEDGNGLEGAVFKIIDSEGKTVKDDLISKEGGKIEAGDLAPGSYQFVEKHAPDGYLLSTDPIPFSITGKHEGEPKQVKLTALNKKNSVVLTKVGQDDKSAGLQGAQFDLTDETGKVLKTGLATDADGRITVYGLKPGNYQFVETKAPKHYQLDKTPISFTVKNTDTKQIELTAENQLTPGDVKLTKVDSNNKKAVLKGAEFKLLDADGKPVKAGGNSKKLPAVWTTDQNGQFTAEGLAPGRYQFVETKAPDGYKLDETPIPFEIKKGQTKPVEVIASNEKLKTPAVDKGAPDPNSGDPKTDNKGTPDRNSKGDPKTNDNGHLKDTLPKTGDTDSIIPIMIGILLILSGGAFAFFTRKKQRKA

SEQ ID NO: 4755 - protein, 210 aa, Bacillus licheniformis
MYKKMIVAVLVISGILFVLSPFIKESIIINLNKNKNFDLTAEQAEQNNAQKASFDFEAIQPPSILETIKASLDRESKAVIGRITISSVNLKLPILKGTTNQNLLYGATTMRPDQKMGEGNYPLAGHHMKRESLLFGPLLNIEKGDTVKITDFKKDYIYAVTSKQFISEMDTDVIQETKKKEITLITCDKAVRTEGRLAVKGKLIHVAVHR

SEQ ID NO: 4756 - protein, 36 aa, Bacillus licheniformis
MSKIAANPGMKEKYPIRIVSFSFFVISHYFFTLVIS

SEQ ID NO: 4757 - protein, 473 aa, Bacillus licheniformis
MNEQGNQKSFLRTIILVSTFGGLLFGYDTGVINGALPYMSEGDQLNLTAFTEGLVASSLLLGAALGAVFGGRLSDYIGRRKNIIFLAVLFFFSTLGCTLAPDVTVMVISRFLLGVAVGGASVTVPTYLAEMSPSEKRGRMVTQNELMIVSGQLLAFTFNAILGTTMGDSSHVWRYMLAIAAVPAVFLFFGMLRMPESPRWLVSKGKNEAALGVLKRIRKEKRAHSEVAEIEAAVMKESEMKKANYKDLAVPWVRRIVFLGIGIAVVQQITGVNSIMYYGTEILKNAGFETKAALIGNIANGVISVLATFVGIWLLGKVGRRPMLLTGLIGTTSALLLIGIFSNVLQGSAALPYVVLTLTVTFLAFQQGAISPVTWLMLSEIFPLRVRGLGMGVTVFCLWIANFFVGFSFPILLESIGLSSTFYIFVGLGLLSIAFVKKFLPETKGLTLEQLEHNFRNYKSETAQSGASAKISG

SEQ ID NO: 4758 - protein, 327 aa, Bacillus licheniformis
MDEFELIQRITPRSLSHREIEIGIGDDAAVYHTKNNYQEIVAVDTMVDGIHFLSSHSSPADIGYKALAVNISDIAAMGGRPKYYLVSIAVPSGWGATDIEAMYEEMNKLATLYEMDLIGGDTVSANGPLVLTVTAIGEIEKGRSCLRSHAEPGDVVFVTGELGSSAAGLSFILGQTSARDETQSQYFIERHKRPEPRVEAGLICSRYHHVALNDISDGLASELNEIAEASRVSIDIYKELIPVHSDLHILHTKWEEWVLFGGEDFELVGTISNDQWERFSQECSEHDVRVHQIGRVTKQGQAEVFYHDGQDRVLLEKKGYNHFKQDR

SEQ ID NO: 4759 - protein, 158 aa, Bacillus licheniformis
MKTLEWKTTEPEETKNIARLAAKYVQPGDVITLEGDLGAGKTTFTKGFAEGIGIKRVVSSPTFTIIKEYRDGSLPLFHMDVYRMEDETEDLGLDEYFEGDGVCLVEWAHLIEEQLPKERLEVVIKRLGDDKRKLTFTPKGRRYENLCEEISKHDDTCD

SEQ ID NO: 4760 - protein, 229 aa, Bacillus licheniformis
MTILAIDTSNLTLGVALIKDGKVIAEHISHLKKNHSVRAMPAIDELLKECGLKPSDLTQIAVAKGPGSYTGVRIGVTIAKTLAWSLNIPVKTVSSLEVLAANGRFFQGLICPLFDARRGQVYTGLYQYRDGKLHGLEEDQNILLEDWLKKLKAMDQQVLFIGSDTGIHREMIERILDEQAVIADPALQLPRPSELALIGELKEDEPVHSIVPNYIRLAEAEAVWLEKQK

SEQ ID NO: 4761 - protein, 152 aa, Bacillus licheniformis
MNTQMVIRDMNPKDLDQVFEIEKSSFSSPWKKESFHHELFHNMYAHYLVLEVEEQVVGYCGIWIVMDDAQITNIAVSPAYRGRRFGEALLKAAMKLCRMKRAVQLSLEVRVSNHIAQSLYKKLGFEPGGIRKNYYTDNGEDALLMWVRLNES

SEQ ID NO: 4762 - protein, 341 aa, Bacillus licheniformis
MNHKKDLYVLGIETSCDETAAAIVKNGTDIISNVVASQIESHKRFGGVVPEIASRHHVEQITIVLEEAFAQADMTFDDIDAIAVTEGPGLVGALLIGVNAAKALSFARGIPLVGVHHIAGHIYANRLVQDIQFPAIALVVSGGHTELVYMKEHGSFEVIGETLDDAAGEAYDKVARTMGLPYPGGPHIDKLAQKGEANVPLPRAWLEEGSYHFSFSGLKSAVINTLHNASQKGETIAPEDLSASFQESVIDVLVTKTERAAEAYGVKQVLLAGGVAANKGLRAALEKTFSSRPEIELLIPPLSLCTDNAAMIAAAGTVAFEKGIRGKYDMNGQPGLDLTSY

SEQ ID NO: 4763 - protein, 240 aa, Bacillus licheniformis
MTSSKRVLDELWDDYPEMNEKDIRTCLGNFLFSGEDVLKPVHALSGGEKARLALAKLMLQKANFLILDEPTNHLDLDSKEVLENALIDYPGTILFVSHDRYFINRIATKVLELSRDKAEEYLGDYDYYTEKKAQQLELKELEKQTEERQKAASEKPGAKKSYEEEKELKRKERQRQRRIEDIETRITAIEEQIEKNEELLCNPDVFQDHEKVQEIHSENEQLNEELEQLLSEWETLSTNE

SEQ ID NO: 4764 - protein, 405 aa, Bacillus licheniformis
MMILQVNQLSKSFGADTILTNIKLEVRSRDRIAVVGRNGAGKSTLLKIIAGKLSYEKGDIIKPKDLTMGYLDQHSGLDSKLTLKEELLSVFDFLKKMEKEMRAIEEKMAQAGPDKLESLMKTYDRLQQEFKDKGGYQYEAEVRSVMHGLGFAGFDDSVRVQDLSGGQKTRLALGKMLLTKPDLLILDEPTNHLDIDTLTWLEQYLQSYSGAILIVSHDRYFLDKVVTQVYEITRSQSKKYIGNYSSYLQLKAEQLERETKLYEKQQDEIAKLQDFVDRNLARASTTKRAQSRRKQLERMEIMDKPLGDEKSASFRFEITRQSGNDVLRVEDLTVSYQDQPPLLRSLDFRITRGESVALVGPNGIGKSTLLKALIQPAAAAVVSNSRRGALVVSYRSDTTTRNRLN

SEQ ID NO: 4765 - protein, 168 aa, Bacillus licheniformis
MNEFTHFNEQGRAKMVDISEKEASVRTAAAVSSVSMNREVHEKIKNREIGKGDVLAVAQVAGIMAAKQTSAIIPMCHPIALKGVDIAFCWEKKEQKSILHIQSNVKTKGSTGVEMEALTSASVCALTVYDMCKAADKGMVIGPTFLLEKTGGKNGDYKREKADVDMED

SEQ ID NO: 4766 - protein, 215 aa, Bacillus licheniformis
MNMDHSKIPQATAKRLPLYYRFLKNLHASGKQRVSSAELSDAVKVDSATIRRDFSYFGALGKKGYGYNVNYLLSFFRKTLDQDETTNVTLIGVGNLGTAFLHYNFIKNNNTKIAMAFDINEEKIGTEVGGVPVYDLNKLEEHMTDDDIPVAILTVPAQAAQSITDRLVALGIKGILNFTPARLNVPEHIRIHHIDLAVELQSLVYFLKHYSMQEK

SEQ ID NO: 4767 - protein, 59 aa, Bacillus licheniformis
MPTIGPGSFILIVVVALLIFGPKKLPELGRAAGNTLREFKNATKGLADDDSDNKKKEDQ

SEQ ID NO: 4768 - protein, 220 aa, Bacillus licheniformis
MAKPLIIYLQQTDEAKLLTLNAFKLTDPLFVYVQFAFIIGAVLTSPLVLYQLWAFISPGLYEKERKVTLSYIPISIILFLGGIAFSYFILFPFVVDFMTRVSDDLNVNQVIGIHEYFQFLLQLTLPFGLLFQMPVVIMFITRLGLVTPMFLAKIRKYAYFVLFVIAALITPPELLSHLMVSVPLLILYEISIVISRISYRQAQKTMIQEENQSFLNDHTK

SEQ ID NO: 4769 - protein, 63 aa, Bacillus licheniformis
MRSPKFWGVIYLLTGVLFTYLAATSPGSMWSFYTILLMLFAAYNISISFKMFALAGRMKRKDQ

SEQ ID NO: 4770 - protein, 211 aa, Bacillus licheniformis
MRKQYWFIILAYVLMQLSAVVGLPLLYFLGVGRGQPKAEAQLTLTGVWSVIAFTLCLVIVLLILRTVPKTTLRNRPKASVAASIGWAVAGVFLALFAQSIAASIEMNLFGVNPESENMQRIMKIITALPLMVFVSSVFGPILEEIIFRKIIFGAIYEKTNFFVAALFSSVLFSVVHLDFSHLLIYTAMGFTFAFFMSGPTGLSSRFSPMSP

SEQ ID NO: 4771 - protein, 94 aa, Bacillus licheniformis
MLKPLGDRVVIELVESEEKTASGIVLPDSAKEKPQEGKVVAAGSGRVLESGERVALEVKTGDRIIFSKYAGTEVKYEGTDYLILRESDILAVIG

SEQ ID NO: 4772 - protein, 544 aa, Bacillus licheniformis
MAKDIKFSEEARRSMLRGVDALADAVKVTLGPKGRNVVLEKKFGSPLITNDGVTIAKEIELEDAFENMGAKLVAEVASKTNDVAGDGTTTATVLAQAMIREGLKNVTAGANPVGVRKGIEQAVAVAVESLKEISKPIEGKESIAQVASISAADEEVGSLIAEAMERVGNDGVITIEESKGFTTELEVVEGMQFDRGYASPYMVTDSDKMEAVLENPYILVTDKKITNIQEILPVLEQVVQQGKPLLLIAEDVEGEALATLVVNKLRGTFNAVAVKAPGFGDRRKAMLEDISILTGAEVITEDLGLDLKSTQINQLGRASKVVVTKENTTIVEGAGDTEQIAARVNQIRAQVEETTSEFDKEKLQERLAKLAGGVAVIKVGAATETELKERKLRIEDALNSTRAAVEEGIVSGGGTALVNVYNKVAALEAEGDELTGINIVLRALEEPIRQIAHNAGLEGSVIVERLKNEEIGVGYNAATGEWVNMIDKGIVDPTKVTRSALQNAASVAAMFLTTEAVVADKPEENKGGAGMPDMGGMGGMGGMM

SEQ ID NO: 4773 - protein, 77 aa, Bacillus licheniformis
MKQEPFKAGGGATSGLALISRVIPVPPTQLASVISGVIGGGLVGFGQMIQDEHEGHGVRIRFTGLGYAAVPTGVFPQ

SEQ ID NO: 4774 - protein, 115 aa, Bacillus licheniformis
MSMNDVKKLEAYLKLNADGTLTLDPSYTKLDISRSVTNEVQDWIKYLNDLVKQKEAVINSDFSVKILDKDGSVLTLENGNNHKMKVAKKGCGRSGHDLYWWGYNLYFDCNETRTI

SEQ ID NO: 4775 - protein, 104 aa, Bacillus licheniformis
MMLSEHLSLLRELESNRNKVKRPVLDMVQIEDMDKIICEAMEFNLTVLFSVFKPLPFLNRAESGETINIEGKIHYINHIRKVFHIVEGDTNFIKFEDAVFREIK

SEQ ID NO: 4776 - protein, 36 aa, Bacillus licheniformis
MTIFLKSPIFHKESNLGLAVLMPFADALAVERDYGQ

SEQ ID NO: 4777 - protein, 69 aa, Bacillus licheniformis
MVKKIVNGFNSFSLLGTIFFIGSYFTYKFNGVELVGFLYLGIIFLTALIATTVMLIRLKRKGINKDKQA

SEQ ID NO: 4778 - protein, 305 aa, Bacillus licheniformis
MLKIWMTGLLLLAQPAGHSDSLTITQQGKKVAVVNREDFTMPLPGTPMIDDKKYNEFVDRLERKVHKDPVNAVINDQGRIVPGKVGYSLSRKGFKEQFYAYFYGDGPSTIEVPELNVYPKVDSELLSHIRTQRIGQYVTYFNSGNKSRTHNISLAAKAIDNHVVFPNETFSFNKVVGMRTPDKGYMKAPVIVRGELSEGVGGGICQVSSTLFNAVDRAGLEIVQRYSHSRRVPYVPPGRDATVSWGGPDLRFQNKYNQPVLIRAKRHGGTMVVTLYSSDVVNHQLRKVPKAPAQIPKEEHQSGDH

SEQ ID NO: 4779 - protein, 149 aa, Bacillus licheniformis
MTWLFVTFLVIFSLFKILVTCLPSGVVEWLTGKFQVHVKLEESNVQVTFGGKRLEGSDKSRFIQNFNEAVFMERYYIYPGDEPLYVNPKNAGTPFVIETTKGKNAVKLFVYRYDDHIDVVKQYKKKTAAYCLRSDSLQTCGGMKTADLI

SEQ ID NO: 4780 - protein, 153 aa, Bacillus licheniformis
MTIHIQQLEAPLNREFVDELINLWNDNTLETADCALDDQDREMIHQQLEQYVQSAYGAVFAVVNEKQEAVGYGLASIKKDLVSDCLSGQIDEVYIAPDYRRNKLGKLVADRMMDWFEQHQVSHVQVSVDIDNQSALHFWEGIGFSSDFYLLTN

SEQ ID NO: 4781 - protein, 224 aa, Bacillus licheniformis
MCGRFTLFSEFDEIIDRFEIDQMAIEDYSPSYNIAPSQYILAVINDGSHNRLGRLRWGLIPPWSKDEKIGYKMINARAETLAEKPSFRKPLIRQRCLIPADSFYEWKRTDAKTKRPMRIKLKTNRLFSFAGLWEKWQPAGGKPVYTCTIITTTPNDLMKDIHDRMPVILDRQAEKEWLNPKNQNLAYLESLLKPYASKEMEAYEVAPLVNSPHHNSPELIKKAP

SEQ ID NO: 4782 - protein, 204 aa, Bacillus licheniformis
MPLQLYEKEQILDACLEVFARHGYAKTSTGMLAEAAGISKALIFHHFKSKKDLYLTVLDYCIEKVKSRLSLDDLASYDDFFEAKEKISMAKLEFFADYSNVYKLTKDAFYSPPSELKKEIAAKYGEQFAVRNRILKQLFAKVPLREGVDREEAFELIMVMMGHFEQKFLAEVTAEDDFDPAWSRRLLEERKRFLDMIRFGIEGE

SEQ ID NO: 4783 - protein, 873 aa, Bacillus licheniformis
MGHYVLGFHEIDRTDLPLIGGKGLNLGELSKMDGIQVPPGFCITTKAYEKMIGENDKVSEQIDQLSLLKVKDRKQINDLALQIRNGIERAEIAEEIKEAVKSAHSNAGGDAYAVRSSATAEDLPHASFAGQQDTYLNIKGIEAILKHISKCWASLFTERAVIYRIQNGFDHRKVQLSVVVQQMVFPDASGILFTADPITSNRKVTSIDASFALGEALVSGTVSADNYKVREGAIIQKTISEKKTAVYSLESGGTEAREVEAGCRKEQTLTDEQIIRLEKLGRRIEAHFGFPQDIEWCLADGEFFFVQSRPITTLFPLPKQSDDKLRVYMSVGHQQMMTEPINPLGISFFGLISDYELTCAGGRLFIDLSHDLASFAGRKVVLSTAGKNDPFMHSALVNFLKRKELVKTLPKGKRMFRLGAEGLSWSLPGDALKIYRKNDTDVVKRLMSKAEASIQEAEQRLKNASGETLFAQIEEDQKSLKKVLYDSESMAVIMVGLYAVYWLNRKMEKWLGEKNVADTLSQSVLYNVTSEMGLALLDVSDAARGYPEVQKYLAYANNETFFEDLKQLDGGPAFIGALRAFLEKYGMRCTGEIDITKTRWSERPSILAPIILSNIKNFEPGARTAKFEQGRLEAEKKERDLLSRLQQLKGGRQKAKRTKKMISVLRNFIGYREYPKYALIKRYFIYKEALMKEAAVLQQKKLIQAKEDIYYLSFDELKEAVCTNRLDVKKIEERKAEYRHYEKLTPPRIMTSEGEVITGEALGDHIPAGALAGVPVSSGIIEGRARVILKLEEADIEEGDILVTPFTDPSWTPLFVSIKGLVTEVGGLMTHGAVIAREYGLPAVVGVEHATKEIKDGQKIRINGSEGYVEILE

SEQ ID NO: 4784 - protein, 94 aa, Bacillus licheniformis
MEMNLFWIGLGLAALGYFIGDGLKNFKNPKGIYSGYPYLIKEDDLHYYLGLSKVETKEMLRKYPDIPKIELNGTTYYPYQQLMDWMLSADLYKN

SEQ ID NO: 4785 - protein, 120 aa, Bacillus licheniformis
MPFILQRIYQENQQTEGRRILIDRVWPRGISKEKANPDCWMKEIAPSPELRKWFGHDPKKFESFKEAYQNEIKQNAEKQKSFRELKKMAADETVILLYGAKDERHNHAVVLYEMLNRQSL

SEQ ID NO: 4786 - protein, 254 aa, Bacillus licheniformis
MELSGNTVLITGGASGIGFAFAERFIKAGNTVIVCGRRESKLKEAKEKHPELITCVCDVAVETERLALFEWIKEHHPGVNVLVNNAGIQQRYHILKADVIDNWADYNKEITVNMEAPIHLAMLFSRYFAEKAGKTAIINVSSGLAFTPMAVAPIYSSTKAALHSFTMSLRHQLSEAGVEVIEVAPPAVNTDLGGVGLHDSGAPLDEFADAIFKGLEEGRLEIGYAVSEKALRMSRDEIDESVSQLYSSLKHSIE

SEQ ID NO: 4787 - protein, 490 aa, Bacillus licheniformis
MYDTTVETRFGKLKGRAENGVRIFKGVPYAKPPVGDLRFREPQRMEAWEGELDAFQFGPVCPQPDGVLPESAGVQKSEDCLYLNVYAPEEADGDLPVMVWIHGGAFYRGAGSEPLYDGTQLAKQGKVIVVTINYRLGPFGFLHLSSIDDSYSSNLGLLDQIAALEWVKDNIAFFGGDRHHITVFGESAGSMSIASLLAMPKAKGLFQQAIMESGASATMSDKLAKAAAERFLRILDIDHHHLERLHDVSDQELLEAADQLRTLMGENIFELIFLPALDEKTLPLKPEVAVAKGAAKEINLLIGTNRDEGVLFFPSDSDLLPESKINEILEEYMGKEAAEAASSLYPRSLEGHVDMMTDLIFWHPSVVFASAQSRYASVFMYRFDWHADSEQPPFNKAAHGLEIPFVFGNMDILEQLTGTKAGEEAQLLAEQIQAAWVSFARSGNPSTDDVSWPDYDEDSRKTLIFDQEVAVESDPYSDKRKMLTAPNPQI

SEQ ID NO: 4788 - protein, 425 aa, Bacillus licheniformis
MPGRKKGSLKSTITVAMSNYLEAGSIVAGAGGLSLWVEYLGLDDARVGLLGALSANGFGAAIGAFLGGFLVDRYGRKFIYKYDLLVYMLGVLLIAASFNFPMLLTGYIVTGIAVGAAIPAAWTYIAEEAPDHERAGRVGWGQLAWSVGPALTLLLSVALAPLGLMGSRLIFAQLFVVAVITWILQQQIHESSIWEEQKRKEAEDKAKGVEEKASIKELLTNKANLRAMILLIGIYAFWNLVAGTMGYFMPYIYETVGGLTAAQANLLQAFLWILTVASTYFVFIRLGDKVNRKLLFGIGAAMATAAWVILTFGTMNITELLLFVCLWGISAGFGAQAFYGLWAAELFHTKYRALAQGFMFFIVRIGVGLISLVVPAMITGLGFKTAGAVMIAFLVIHMIIGLRMAPETRGKSLEAIQSERYHQSG

SEQ ID NO: 4789 - protein, 226 aa, Bacillus licheniformis
MSILSRFKDIMASNINALLDKAENTEKMVDQYVRNLNSDLNKVKAETASVMAAEQRAKRELADCRAEIDKLERYAMKALEAGSEADARTFLEKKAVLETKASELETAFQTASSNANQMKKMHDKLVSDIGELEARRAAIKAKWTAAKTQERMNKLGASAANANHSMSAFGRMEEKANRALDEANAMAELNAAPQDDIEDLKAKYDSPSNVDDALAALKAKMAGQKS

SEQ ID NO: 4790 - protein, 341 aa, Bacillus licheniformis
MVISYKCPGCGDDMAFDAESGTLACRSCGRQDKIENIPEELKTARFTEDEATEYHCQNCGAILITEKETTATSCSFCGGAAVIADRLSGSLAPAKVIPFTISKEEAADAFRKWCRKGLLTPKGFMSADRIKSITGMYVPFWMYDLNSKVQVSARCTKVHRYIQGDYIYTETEHYDAFRDINLDYIKVPVDASEKMNDQLMDKLEPYPYDQLKDFKTAYLAGYIAEKYNYDDEELFPRAKSKISGYIESYIDSTLSGYSSVDVKTKHVDTQKVKSLYVLLPVWMVNYNYKQKDYIFAMNGQTGKVVGKPPISSFKEKMWFSGLAVSIFALWKIIAAVMGGGA

SEQ ID NO: 4791 - protein, 255 aa, Bacillus licheniformis
MRSLLRSAMILCMIFLVFIPIASGAAASEQKRFVYDEAGLLTKQEIEKLETLAAKLGAERETDFIIVTTNDTNGRDVKKYAEDFYDEKAPGYQKKHGNAAVLTVDMEHREVYLAGFKKAEEYLNDARLDKIREKITPDISDKHYEAAFEMFMKAAHDDMEKKPWADSIFFKTWFQLLVSAVIAGIAVAIMKYNSGGKVTVSASTYMNGDTSGVIRNNDEYIRTTVTKQRKPSNNKSSGGGTTSGGHSHSGSRGSF

SEQ ID NO: 4792 - protein, 324 aa, Bacillus licheniformis
MVFFRNQFANVVEWDEFRDDMIFYKWNNREIKKGSRLIIRPGQDAVFLNNGKIEGIFQDEGDYDIESEIIPFLSTLKGFKFGFNSGMRAEVLFVNTKEFTVKWGTKNAINIPAAGLPGGMPIRANGRFNFKVNDYVALIDKIAGVKDQYVVEDIKIRITSILDQLLMKWITKEGKDMFNLQANAFDIAKGIKEDLDMEIVGDGMTITGFNIMSFNYPKEVQDMITKNASHGMVGDLNRYQQISMTDGMASGKMTGGGAASDMAGMMMGMNVANQMMNQMNQNQQAQTQTPPSAPQPAAKPNFCPNCGTKTGEANFCPNCGQKLV

SEQ ID NO: 4793 - protein, 351 aa, Bacillus licheniformis
MELGISTFVETTPDIKTGKVISHAERLREVVEEIVLADQVGLDVFGVGEHHRQDYAASSPAVVLAAAASQTKRIRLTSAVTVLSSADPVRVFQDFATLDGISNGRAEIMAGRGSFIESFPLFGYDLDDYDELFEEKLDLLLELQKSERVTWSGKHRPAIHNTGVYPRPVQKPLPVWIGSGGNQESVVRAGLLGLPLVLAIIGGSPQHFAPLVELYYKAAEHAGHDASKLIVASHSHGFIAEDTETAADRFFPSTQQAMNTLARERGWGPYSRSSFDAARSFEGALYVGDPETVAEKIIHLRKNVGITRFLLHVPVGSMPHEDVMKAIELFGTKTAPLVREEVSRWEASERS

SEQ ID NO: 4794 - protein, 275 aa, Bacillus licheniformis
MKENILDVLKNLNFTEYESKAYLALLEESPLTGYAVAKKSGVPRSKIYEVLESLVIRGDIFVSYGNTPQYIPVPAKDLIKNRRMKAEETFEQAEKYFEKFERTANDRENIWNITGRSEILDKVKACISSAGKRILLEIWKEDFPELEPELKRAAKKGVIVTIIAYGDIEADFANVYLHDNSRQITEEYDGRWLVFSVDDSEVVAGIVSHGKDSRAAWTMHVGLVMPITEVMIHDLYLMEIMEKHREVLEESFGENLIHLRRKFSIHPDFKKHYMK

SEQ ID NO: 4795 - protein, 167 aa, Bacillus licheniformis
MATGLSFWTLIAVLGLAVVIAKSVILFNTIKYLGAAYLIYLGIKSFFAKKMFSLEEIQAEKNKNENASSRHYKDSFMQGLFSNILNPKTVLVYITIMPQFINLRESVNQQLIILALILTFLAVFWFLILVYLIDFAKKWLRSVKFQKIFQKAAGLVLVGFGVKTGLD

SEQ ID NO: 4796 - protein, 214 aa, Bacillus licheniformis
MDEQKKNQLGVLLKEQLRKRSLSLRELSERTQIDKATISRIINGKRKANLNHLQRFSESFGVSFDELMTAAGYAMEKTQESERPDIHSSVAEIEDVLQTSNVYDRPFTMEELKNKLNECEQYSQTEEGKRTILAEFESKIEKVAGIGPFLTRLHDMYSRFTSGRGTPRELLLMGGALLYFIVSVDVIPDYIFPIGYIDDAAAVHFVFNQLSYKS

SEQ ID NO: 4797 - protein, 385 aa, Bacillus licheniformis
MKRKHINIDISLLLILFCLFIISLLAVYSGSGQYETQDPFYFAKRQVFWYLVGFGVMAGTAYIDYELLERLALRLFVGAVFLLILVHFFGTYKNGSQRWISFGVIEIQPSEFMKIILILLLASILNQFQHKRFSFAESIIPTGKIMMYTVIPFFFILVQPDLGSALVILSIAFTLMLVSGISGRMIVSLSLGFMALVAFLTYLHNHYFEIFSKIIKPHQLDRIYGWLSPHEHASTYGYQLTQALLGIGSGQLSGSGFTQGIQVQGGKIPEAHTDFIFAVIGEEFGFLGAVTLVCLYFLMIYRIIRIALSSNSLFGLYICAGVAGLIVFQVFQNIGMTIGLMPITGLALPFISYGGSALLTNMIALGLVFSVNIRSKHYMFGNDWG

SEQ ID NO: 4798 - protein, 382 aa, Bacillus licheniformis
MKLLKMILSHLKKLDYVLIAAVLFLSAFGLLMVYSAGYPLGYMKYHDGSYFFMKQLQWLLIGLAFFSAAAIFPYKAYSKLIRFLVKLSFLMLILVLLPGIGMEKNNSQRWIQFGSLMIQPSEAVKLVMVIYFAYVYAKKQKYIADFGKGVMPPLLILAAVFFLILKQPDLGTAVSILLSCGAVLLCAGLRMRHLLLLGTMAGAGIAYFAITAPYRLKRLTSFSDPFQNENGDGYQLINSYLAIDSGGLWGNGLGNSVQKLGFLPEAHTDFIMAVITEELGGIGLAVIIWAYLLIMFRGVRIAVQIDDPFGKLLAVGLTFQIMIQALFNLGAVFGLLPITGIPLPFVSYGGSSLLFMLTTAGILVNLSSHVKRGVKKDVAFLL

SEQ ID NO: 4799 - protein, 53 aa, Bacillus licheniformis
MSRVPAKKKQHLLSLTAERFKKTAVFQICMSTDIYGNNSAFWYNKGWQQFGSI

SEQ ID NO: 4800 - protein, 141 aa, Bacillus licheniformis
MKTRFTPYILMNGRAKEAIDYYRDVLDAEVKFSQTIGEGPADEAANFKEDELDFIAHAVLTIGDAVLMIADIIPELPFQSGNQLSICVTAADVSSAKRLFGKLSERGEVKLELKETYFSPAYGIVTDPFGVAFQIFAARPA

SEQ ID NO: 4801 - protein, 319 aa, Bacillus licheniformis
MEVFMSKAKRLNEMIMMVNRKKRFTVGELAREFGVSKRTVLRDLQELSEMGVPLYSETGPHGGYQVLNERILPPIAFSENEAISIFFAIDALKHYISLPFDAQYASIKKKFYLNLSGDIRDAIDSMKDRVAFYTPYEQTDDIPVLKVLLEAAVQQKVLIIEYEANGASSKRSIQPIGIYANQGKWYCPAYCFLRKDYRIFRCDRIKRAELDEHKAPIDLSGLNLKNRFSALSRPRETLELSAELTKKGVERHGSLKWPHLELHVREDGSGVLKGEIAPKDIDFFADYFISFGREAVIQKPSKLIERMKRTLSDMLKQYG

SEQ ID NO: 4802 - protein, 225 aa, Bacillus licheniformis
MKKAMAILGFLVLTASLLFIINKGTSQINASQNRKAAVHTEYYKDISSLSFPVFSDLKEEDAKLANDAVKLHLKNSYKEFQKIVNDAEKKDKDEENVYETSYKVKYNEEGKLSFLIYDYQFSGGAHGMYTVTSYNFDFDKHKQVVLTDVLNNQAKIEKAKNYIFSYINEHPEQFYSDLKKSDIRLDEHTAFYYTSSGISIVFQQYDIAPYAAGNQEIKLPSTLLY

SEQ ID NO: 4803 - protein, 438 aa, Bacillus licheniformis
MAGYSYNKVSSNSQEPPQPKKDRGQSGLGVESMVNDSKQERYAIHYPVFHIKEIDEQIKDYVNQELAGFKEDNAKAQAQDEDGPFELNIKYKVVYYTKDTASVVLNQYIEAGGVSGTTSVKTFNADLKQKKLLSLQDLFEENSDFLNRISSIAYQELKNRNPSADMALLKEGTSPQEEHFSRFALLENEVEFYFEKKQTGLEQSVKIKKEWVKDILKDRYQDMKKNRLQAKPDQEPVPLPKQAKINPDEKVIALTFDDGPNPATTNKILNALQKHEGHATFFVLGSRAQYYPETIKRMLKEGNEVGNHSWDHPLLTRLSNEKAYQEINDTQEMIEKISGHLPVHLRPPYGGINDSVRSLSNLKVSLWDVDPEDWKYKNKQKIVNHVMSHAGDGKIVLMHDIYATSADAAEEIIKKLKAKGYQLVTVSQLEEVKKQRGY

SEQ ID NO: 4804 - protein, 512 aa, Bacillus licheniformis
MKQQKRLYARLLPLLFALIFLLPHSAAAAANLKGTLMQYFEWYMPNDGQHWKRLQNDSAYLAEHGITAVWIPPAYKGTSQADVGYGAYDLYDLGEFHQKGTVRTKYGTKGELQSAIKSLHSRDINVYGDVVINHKGGADATEDVTAVEVDPADRNRVISGEHRIKAWTHFHFPGRGSTYSDFKWHWYHFDGTDWDESRKLNRIYKFQGKAWDWEVSNENGNYDYLMYADIDYDHPDVAAEIKRWGTWYANELQLDGFRLDAVKHIKFSFLRDWVNHVREKTGKEMFTVAEYWQNDLGALENYLNKTNFNHSVFDVPLHYQFHAASTQGGGYDMRKLLNGTVVSKHPLKAVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 4805 - protein, 316 aa, Bacillus licheniformis
MATLSDVAKKANVSKMTVSRVINHPETVTDELKKLVHSAMKELNYIPNYAARALVQNRTQVVKLLILEEMDTTEPYYMNLLTGISRELDRHHYALQLVTRKSLNIGQCDGIIATGLRKADFEGLIKVFEKPVVVFGQNEMGYDFIDVNNEKGTYMATRHVIGLGVRNVVFFGIDLDEPFERSREKGYLQAMEGSLKKAAIFRMENSSKKSEARAREVLASFDAPAAVVCASDRIALGVIRAVQSLGKRIPEDVAVTGYDGVFLDRIASPRLTTVRQPVVEMGEACARILLKKINEDGAPQGNQFFEPELIVRESTL

SEQ ID NO: 4806 - protein, 586 aa, Bacillus licheniformis
MEYAAIHHQPFSSDAYSYNGRTLHIKIRTKKDDAEHVRLVWGDPYEYTGGTWKANELAMAKIAATSTHDYWFAEVAPPFRRLQYGFILTGADDRDTFYGSNGACPFAGKAADIGKHCFKFPFVHEADTFDAPDWVKSTVWYQIFPERFASGREDLSPENALPWGSKDPEAHDFFGGDLQGIMDKLDYLEDLGVGGIYLTPIFAAPSNHKYDTLDYCSIDPHFGDEELFRTLVSRIHERGMKIMLDAVFNHIGSASQEWQDVVKNGETSRYKDWFHIHSFPVKEGSYDTFAFTPEMPKLNTANPEVQAYLLDIALYWIREFDIDGWRLDVANEVDHAFWKKFRQAVTAEKPDIFILGEIWHQADPWLRGDEFHSVMNYPFTEPMIDYFADGSISASQMASRINSHLMSGMKQVNEVMFNLLDSHDTKRILTRCGGDDKKVRSLLAFMFAQTGSPCIYYGTEVGLDGGDDPLCRKCMVWEEEKQNQEMLAFMKRLIALRKQENDVLTYGALEWKLVDDQNDFVSFSRTHEGKELIYFFHQGSEVRRVRLRDLKIASDKRIYDAWTEEALQHDDVVDIQPGGFFILGAV

SEQ ID NO: 4807 - protein, 417 aa, Bacillus licheniformis
MQHLKKGILVLLASVLLFGLAACSSSKETGGSGGKKVLTVSVEEVYKPYVESIKEGFEKENDVTVKIVEKPMFDQLEALPLDGPAGNAPDVMLAAYDRIGGLGQQGHLLEVKPSDTKSFGDKEMQQVTVGGKVYGIPLVIETLVLYYNKDLLKTPPKTFNELEDLTKDKRFAFSSEKGKSTAFLAKWTDFYMSYGLMAGYGGYVFGADGTDSGDIGLNNKGAVEAVEYAEKWFSEYWPKGMQDNTSADDFIQQTFMDGKAAAVIGGPWSASNYKEAGLNYGAAKIPTLPNGKEYAPFAGGKGWVASKYTKEPELAEKWLQYAANDENAYRFYEDTNEVPANLAARKKAGEQKSELTSAVITQYETATPTPNIPEMAEVWTGAESLIFDAAAGKKSAQQSADDAVRVIKENIKEKYVK

SEQ ID NO: 4808 - protein, 435 aa, Bacillus licheniformis
MNKDQTLANRSRKAALLSIIPGAGQIANRQFSKGILFLVITGLFICELAIFGYQALIGLVTLGTVPGEDHSLFLLIEGTLQLILTLVFLMFYIFNLYDARKTAAMKAAGLKISETAGDMIRNAGDKGFPYLFTLPAYLMMVFVIIFPVLVTLFIAFTNYDFYHIPPNSLIDWVGFKNFMNIFFLGSYRQTFADVLGWTIIWTICATTLQIVLGIVTALIVNQNFIKGKRMFRIIFLLPWAVPAFITIMSFANIFNDSAGAMNVQVIPLLNQLPFVDIPAVAWKTDPFWTKTALIMIQTWLGFPYIYVMVTGVLQAIPGELYEAAKIDGATFIQRFKHITLPMILFATAPVMITQYTFNFNNFSIIYLFNEGGPGSAGAGAGSTDILISWIYKLTTGTSPQYSVAAAVTLLISFIVIGVSLIAFKKSNAFGNEEVM

SEQ ID NO: 4809 - protein, 283 aa, Bacillus licheniformis
MRGLFKNTRFTGMLNKVLTYIFLAFLSIVIIYPLLITASSAFRVGNVAAFTLDFSGAWTLDHFKRLFEETLYLNWYGNTLVIALSVMVFQVTIVTLAGYTYSRYRFAGRKKSLIFFLIIQMVPTMAALTAFYVLAMLIGALDQYWFLTAIYIGGGIPMNTWLMKGYFDTVPREIDEAARIDGAGHLRIFASVVLPLVKPMLAVQALWAFMGPFGDYLLAKFLLRSPESLTIAVGLQTFISNPQQQKVALFAAGAILAALPICILFFFLQKNFVSGLTSGGTKG

SEQ ID NO: 4810 - protein, 293 aa, Bacillus licheniformis
MNDMRNEKLIVRFLKAAASPAGVMRCKHAFSWLEISFLFMFLTACLMAPMTLAFMKMDRFNAGYLIPNVAQEADAAFIKQLKGYQLTNGRLKGEDELYRVEKGRTLLAVDLKDELKTSGENGRIKAEGYQNALIFQSDHLIISDQSGAGFSVRYPAKAGLNDLDAGHLGDFIGAMWFAQYKPLIIMLACSAVFIISLFLTAVLAGGIWISKKSNMTGIRSFKEAAAAAVCGSALPAGAAMAFGMISFDFIAMLLIHSCGSALMVSFIFRHIFKNRHHNENLQSGGNHGKSAAI

SEQ ID NO: 4811 - protein, 760 aa, Bacillus licheniformis
MANQRLFEIDQWKIKTNKFEKEHKRLQESLTSLANGYMGIRGNFEESYSGESLKGTYIAGVWFPDKTRVGWWKNGYPEYFGKVINAMNFIGIDVYVDDEKVDLSQNDIESFELELNMKEGILRRSAVVRVNQKAVKISSERFLSLDVPQLCAIHYEAECLSDEAVITLVPYLDGNVANEDANFEERFWQEEAKGAESHRGHLVTKTIENPFGTPRFTVAASMCNVTEGYVSEHFQTDAMYAENRYCYEVGPGTKASLKKLIIVTTSRDFEEAELLVQGRALLADVLRQGYEEAKRRHTEHWMERWAKADIEIKGDDELQQGIRYNLFQLFSTYYGADSRLNIGPKGFTGEKYGGAAYWDTEAYAVPMYLATAEPEVTKNLLLYRYHHLEAAKRNAAKLGLKGALYPMVTFTGDECHNEWEITFEEIHRNGAICYAIYNYVNYTGDRDYMKEYGIDVLVEISRFWADRVHFSKRNNKYMIHGVTGPNEYENNVNNNWYTNLIASWTLEYTLENLAILPEEKRRRLDVREAEIEKWKDIIERMYYPYSEELNVFIQHDTFLDKELQAADELEPGDRPLYQNWSWDKILRSSFIKQADVLQGIYFFNHRFTMEEKRRNFEFYEPMTVHESSLSPSVHAVLAAELKMEKKALELYKRTARLDLDNYNHDTEEGLHITSMTGSWLAIVQGFAGMRTQDEKLSFAPFLPKEWDGYSFNINYRDRLINVQVEENSVVFSLLKGEPLSMTVYGEQIALNGRYERRMAR

SEQ ID NO: 4812 - protein, 568 aa, Bacillus licheniformis
MSQWWKEAVVYQIYPRSFYDSNGDGFGDLQGVIQKLDYIKSLGADVIWLCPVFDSPQDDNGYDISDYRSIYEKFGTNDDMFQLIDEVHKRGMKIIMDLVVNHTSDEHAWFAESRKSKDNPYRDYYFWKDPKADGSEPNNWGSIFSGPAWTLDERTGQYYLHYFSKKQPDLNWENEAVRREVYDLMTFWMDRGVDGWRMDVIGSISKFVDFPDYETDDSRPYVVGRYHSNGPRLHEFIQEMNREVLSRYDCMTVGEANGSDVEEAKKYTDPSRHELNMIFTFEHMDIDTKQHSPNGKWQMKPFDPIALKKTMTRWQTALMNVGWNTLYFENHDQPRVISRWGNDRELRKQCAKAFATVLHGMKGTPFIYQGEEIGMTNSEMPLEMYDDLEIKNAYRELVIENKTMTEEDFRKAVAKKGRDHARTPMQWDDGKYAGFTDGEPWLAVNPRYQEINVKESLADEDSIFYYYQKLIGLRKQNKVIVYGDYRLLLEEDPRIFAYIREYRGEKLLVAVNLSEEKALFHASPELLEDRWDVLLSNYARERLNISGSIDMEPYEAFMMISRAKDYTS

SEQ ID NO: 4813 - protein, 226 aa, Bacillus licheniformis
MKAVIFDLDGVITDTAEYHYLAWKHTAEQIGIEIDRSFNERLKGINREQSLDKILIHGGAAGKFQEAEKQEIMRRKNQYYQQLIQNLTPHDLLPGISVLFAELKREHISIALASSSRNAPAILQRLGVMDEFQGVVDPAALAHGKPDPEIFLTAAALLGVPPSECAAIEDAEAGIAAIKSAGMFAVGVGDETSLRGADLIVHNTNELTFELLNEGWQRYCCIREGK

SEQ ID NO: 4814 - protein, 417 aa, Bacillus licheniformis
MQQQQFDQLTTAEKREVERQLHLYMDGAEEVIPPEELRAKLAKSILTGEPLKIKLGLDPSAPDVHLGHTVVLNKLRQFQENGHIVQLLIGDFTGKIGDPTGKSAARKQLTDEEVRRNAETYFQQFGKVLDQNKVELHYNSKWLKRLTLEDVIELAGKITVARLMERDDFEERIAMQKPISLHEFFYPLMQGYDSVVLDSDIELGGTDQHFNVLMGRHFQEKYGKEKQVVILMPLLEGLDGIEKMSKSKNNYIGIDEDPHEMFGKTMSLPDSLMKKYIHLATDLEAEEKKRLVKDLETGAVHPRDAKMLLGKTIVNMYHGSKAAEAAEQQFKKVFQQNSAPDNITAVHWQGGGTVPVTDLLVTLELLPSKSEARRMIQNGGVKINGAKAESIHADIALEHGMIIQVGKRKFVKLQMHQ

SEQ ID NO: 4815 - protein, 168 aa, Bacillus licheniformis
MNRSPHLRQEEHDTLSKLKRMPIESLNLEAISVATNLYRSAQKLRVKMETEVLSSYQLSWTAFSILYDLWVWGRLETRKLAELSGISTATASNVIKTLEKKNFCVKSADPRDRRHVYAEITPEGKAAIEELYPAFHKGETMLIKGMTKEEQNTLIELLRKVNDNLHKP

SEQ ID NO: 4816 - protein, 188 aa, Bacillus licheniformis
MKKKSAPLILIMALSLLLPFAQAEAAGSKGASGVKASSSSANNSALKTRAGSVNQSMRSYMKQSASRRYLNKNSQFNTIQRTLPPDALYKGSIKRTLNQNPAGSAFLNYYFPYWMIFHVGGYTAEQKNILRTAGIKEKALSERKEKRYWLLIEDQNGKKHAVLVSKKQYDSIQKGDRIEVRRKQITKK

SEQ ID NO: 4817 - protein, 130 aa, Bacillus licheniformis
MKKSKLISLSAAAMLLAVPLSGCSSSASDRSQEVADDQSIQKYDLVWFDYVNDSESDKAPLLKAAYVKDGKEKTETFKKYVENVENVEQPYIKIRDQEAFIFRPPYIKYDQEPLEGVVKDKVEQKSSDEQ

SEQ ID NO: 4818 - protein, 139 aa, Bacillus licheniformis
MSEKNPIHGGYFYMKKILFSVFVLAGSLLLAFNFAGEASAKTKKVSGYITWYNGVGKIGADGKRLGHWDCATKMGFDVPRKGTKIRAYSKAKPHKVITVYKYDVGRMPGAVLDVSPKAFRALGFPTSKGKVAGHYTYKK

SEQ ID NO: 4819 - protein, 339 aa, Bacillus licheniformis
MKKVSVVLLAAVILAAGAFAAVRYFVPEKAEPAKSGGSDLLVSITDQKLMTAYYENQNKLYEEKMTDYPAMALDRKKRILYYTNTDNSNVKHLIRLDLQSGKKTTLYSGDEYVDGLSLSADGSKLFMRYNLAEERNFHLASFDLKQKAFHVIYPSLKNKDETVSYYQYNKADNQFVMLHYSLKEDYQKTDDANNKGVPPEPTNMNISMAGVKDRQKVRTIAKFINDVAISPDGKTIVFTESADDQKAIYAMDAETKKYKAIISDQQAFSLVDSAQPQFSKDGKKLYFLAEAKDAKLLEDETGSEARVRTIYSYDMDTKKVSKAWEKTNGIINTFTVIDE

SEQ ID NO: 4820 - protein, 330 aa, Bacillus licheniformis
MASAKLQQRLDQYKAIYSELKSDLKWKVTDQRTLMMIASMYVVNKRPFDKERFLNLSEAVKQAAGTFSPLRSAHRYTFAAMFDVRFEEPETHIRPFFTLYVKMTGNGFKKSIFTYLSALILLTKYRDEHDHDSKINRALSIYKGMKDKHVFLTSAGDYPLSVLLAGSDMETGELIDYIEAFYQKLNQAGFRKGNDLQFLSHILSLMPEQDSDQLVARSLRIYDELTKKHKRPKPVHYPEIGLLALLENGEKDIDAITIMAGALNSDKLFRWQKDMNLKTAVNLYMSEKTEDPALLDTGLYQTLEAVIQAQQTAAIAIMTSSAAASQANGS

SEQ ID NO: 4821 - protein, 100 aa, Bacillus licheniformis
MSVPKDAACSMPHDHQRSLHDLCRKYMHYHVVLKMKDGSSVHGILEGVNRQEASVLIPEDVTDERQFYGGYGYPRRRFRRFRRRIFPFVFIAALYPFPYY

SEQ ID NO: 4822 - protein, 182 aa, Bacillus licheniformis
MKNSRKKEILSWVKTLVIAAALVMVCRYFLFTPSTVLGDSMYPTLEDGNMVMVSKISDIQRFDKIIFHAPDSDENYVKRVIGLPGDTIEMKDDVLYINGKAYDEPYLKKNKQKLTLHEHLTDNFTLEKLTGEQKVPEDHLFVMGDNRQNSKDSRFFGFITMDSVVGKVEFRYFPFNEIGGIE

SEQ ID NO: 4823 - protein, 94 aa, Bacillus licheniformis
MFNRQQIDHLLEEKKGELKKKFGSGFIAVFYISILLSICTFFIEYKYFLIVLFAPTIIVMLINPPFSEKKGVFRFIAGLYLLLLALATYFWLRA

SEQ ID NO: 4824 - protein, 214 aa, Bacillus licheniformis
MKVFVVGANGQIGRRLTKSLNESSEHQVRAMVRNEEQAQALKQSGTETALANLEGTVESIAEAAEGCDAIVFTAGSGGNTGADKTLLVDLDGAVKTIEAAEKAGIRRFIMVSTLQAHRRENWNEALKPYYVAKHYADRMLEGSELNYTIIRPGGLLNEPGTGRVKAAENLERGTIPREDVADTILAALTEEHTFRRSFDLVSGDQTPAEALKSI

SEQ ID NO: 4825 - protein, 292 aa, Bacillus licheniformis
MNMNDYERIQNAVQFIEEHLQNDLNITDIAAKSCFSPFHFQRLFQAISGFSVYQYIRNRRLSEAALLLEKTDRSILDIAINFGYGSQEAFSRAFSQYFGITPAKYRKAKVKLDFQSKINFLEYKERMTGDMNIPKPHITHLNDIHMIGYEYRTNLNDEKYFEDIPKFYNDFGRNGYFMQIPQKTDPNMCYGLSCRFQDDGGFSFIIGEAVRETAAGEVPEPLIYTKIPGGKYAVFHVNGSTESVQNTRRYIYGSWLMNTNYERTEGPDFEVTDVCRSVPPNEMKMTIYIPLL

SEQ ID NO: 4826 - protein, 513 aa, Bacillus licheniformis
MKLEKFVDRLPIPQVLQPQSKSKEMTYYEVTMKEFQQQLHRDLPPTRLFGYNGVYPGPTFEVQKHEKVAVKWLNKLPDRHFLPVDHTLHDDGHHEHEVKTVVHLHGGCTPADSDGYPEAWYTKDFHAKGPFFEREVYEYPNEQDATALWYHDHAMAITRLNVYAGLVGLYFIRDREERSLNLPKGEYEIPLLIQDKSFHEDGSLFYPRQPDNPSPDLPDPSIVPAFCGDTILVNGKVWPFAELEPRKYRFRILNASNTRIFELYFDHDITCHQIGTDGGLLQHPVKVNELVIAPAERCDIIVDFSRAEGKTVTLKKRIGCGGQDADPDTDADIMQFRISKPLKQKDTSSLPRILRKRPFYRRHKINALRNLSLGAAVDQYGRPVLLLNNTKWHEPVTETPALGSTEIWSIINAGRAIHPIHLHLVQFMILDHRPFDIERYQENGELVFTGPAVPPAPNEKGLKDTVKVPPGSVTRIIATFAPYSGRYVWHCHILEHEDYDMMRPLEVTDVRHQ

SEQ ID NO: 4827 - protein, 335 aa, Bacillus licheniformis
MQKRIEWIDVSKGVGIILVVLGHTPTPDWLKTFIFAFHMPLFFFLSGLVYHDGNMTFTSFLLKKIKTLLLPYFIFSVLAYLFWVLVERHFTFTGSSDVDPVVPFKGIFYSMPDDYKLTHNPALWFLTCLFIVEILFFIVKRWGKGRLFIVIAVLVSAALGFLNYQYLGIKLPWNIEVALTAIVFYSAGFLLKNNLKEMRDRRMLLLTLLLFIAVGCLQTLNVRVDMRANEYGNMALFYMTSFLGTAGVIFSSFHLEKARLLQFLGKNSLIILVLHYPVIRMLKAVVYYFTQVSLDETYGSLLWSALYTGMTLLVMVPCIFLLNRYPIVLGRKKCN

SEQ ID NO: 4828 - protein, 164 aa, Bacillus licheniformis
MFASSGSSTQESKSSGSSAKTTAAKTSEEKSNDDAKEKTEFGLNETADLDGTHITVTNVKKSMGNEYFKPNNGNEYVVATLNIENKSDKDISYNPLDFQIQNEDGQITHNTFGPSDDNDLSSGNLTPNGKVSGTITFETKKSKTYKVIYTPEFWNDKKITFNLK

SEQ ID NO: 4829 - protein, 290 aa, Bacillus licheniformis
MERYDELKKGETGAWVSIIAYLVLSAVKLAVGLAFHSEALRADGLNNTTDIIASLAVLIGLRISQKPPDEDHPYGHFRAETIASMIASFIMMVVGLEVLYSSGEMLFNPKETTPDMIAAWTAAGSAVVMFLVFLYNKRLAKKVNSHALYAAAADNKSDAYVSIGTFAGIFASQFNLAWVDTAAAFIIGLIICKTAWGIFKEAAHSLTDGFDIKHISTYKETIRKVPGVGNIKDVKARYLGSAIHVEIIVEVRSDLNIAESHDIADEIERRMQEEHSIVHSHVHIEPSKEK

SEQ ID NO: 4830 - protein, 320 aa, Bacillus licheniformis
MSYEEMLHPVLGKVADNIDKVMVGKKHIAVLSLTAILANGHVLLEDVPGVGKTMMVRTLAKSTGAEFKRIQFTPDLLPSDVTGVSIYNPKTLEFEYRSGPIMGDIILADEINRTSPKTQSALLEAMEEGSVTVDGVTMPLSKPFFVMATQNPVEYEGTYPLPEAQLDRFLFKLRMGYPTVREELQVLDLQENRSPIEEIEPVIEKEELAAFQKEAEKVYVDAAIKEYIVGITQKTRSHSAVYLGVSPRGSIALMKAAQAFAFLYNRDYVIPDDIQYLAPFTLAHRMILRSEAKFEGKRPEAVLQDIMSKTEVPVGRPMSS

SEQ ID NO: 4831 - protein, 403 aa, Bacillus licheniformis
MRERIGLVMYGWKLFILFLLFASTFCYAMFQGGFVSWFLFYSFLPFALYAFLFAFYPLKNLTAERRLSQGQYKAGDQLEAFVVLKRKWPFPIMFMIVEDCLPDSLGKNRGSAEAKQLLFPWFKKEIKMAYTIDSVPRGDHRLAKIRVRTGDPLGLLERECEIQLEASFLVLPSYQEIAYRASGGSYDEHAGRVSELRRKDSTLASGIREYQPGDRFAWVDWKTSARRSQLMTKEFEQTKGDDLLVFMDQSPSEAFEEIVTFTASIIRSAMRSGTNAGLVSIGKERNVFPVRQGEEQLRKLFYYLAIADCNAVQPFHSLIEGELGHSDMRKAVKYIVTSRITIELVQALKKPLSGGRPVICLVKKKGGDLSSEESAAVQHLKARGIEVNVIYGEHFSRGLAEAR

SEQ ID NO: 4832 - protein, 741 aa, Bacillus licheniformis
MLSGGKRNRFGLLLFYVLTFLLLWEWLRPLQYFTDTGHTVFFILFIALVFLLTFFKVPWFIRFPVSLGFVLFALHTIFYEGSVFSPSWIALFFQDLKRNFSYIFSGMWRDMSPLFRTLLFYVLLWLLVYLLHYWVIYQRRILFFFIMTVVYVAVIDTFTPFDASYAIVRIVLIGFLLLGLLYLERIRESEALKSSKSRFAKWFAPLLLMTAAAVCIGAVSPKADPVWPDPVPFLQTAATGDFASSGRSKVGYGTNDEALGGPFSKDDTWVFTWQGNERSYFRVETKSRYTGKGWIEDEKSGASIQLEEDKLDYQWYDESVKTETRKAIVDIDPAYRYDHVLYPIGTTEIKLNNFFVPLRMNLNTEKIKPAGKTGADIQNLESYSVTYKSPVFDVDQLRKVSLESEGKWARSHEKYLQLPTSLPDRVKTLAHDLTKDEDNIYDKAKAIEKYLGSSEFSYETEDVAVPKGDQDYVDQFLFETKIGYCDNFSTAMIVLLRSAGIPARWVKGYTSGEYAGTTADRKRTMYEVTNNNAHSWVEVYFEGQGWVTFEPTKGFLNPEQLVEESSGQQAGAASDKKEDDKKNDEGQRPQDAKEQDNKEKPESQAKRDAKADSHAGSDDADRTLLTGAAVLGLLLAFAAVLYYTRVKWMPHIIINRLKKRRDEAVFFKAYDELLRQLKRQGMQKEEGQTLREFAKTVDERFQSGDMTALTLQYERALYRKEDAAKLWNDSAELWENLIKKR

SEQ ID NO: 4833 - protein, 513 aa, Bacillus licheniformis
MTKLVNEMILVLDFGSQYNQLITRRIREFGVYSELHPHTLTAEEIKKMNPKGIILSGGPNSVYDEGSFRCDEKIFELDIPVLGICYGMQLMTHYLGGKVEAASQREYGKANIHIEGEPDLFKDLPNEQVVWMSHGDLVVEVPEGFTVDATSHHCPNSAMSKKDKKWYGVQFHPEVRHSEYGNDLLKNFVFGVCECVGEWSMENFIEIEMQKIRETVGDKQVLCALSGGVDSSVVAVLIHKAIGDQLTCIFVDHGLLRKGEAEGVMKTFSEGFNMNVIKVDAKDRFLNKLKGVSDPEQKRKIIGNEFIYVFDDEAEKLKGIDFLAQGTLYTDIIESGTATAQTIKSHHNVGGLPEDMQFELIEPLNTLFKDEVRALGTELGIPDEIVWRQPFPGPGLGIRVLGEVTEEKLEIVRESDAILREEIAKADLEKDIWQYFTVLPDIRSVGVMGDARTYDYTIGIRAVTSIDGMTSDWARIPWDVLEKISTRIVNEVKHINRVVYDITSKPPATIEWE

SEQ ID NO: 4834 - protein, 440 aa, Bacillus licheniformis
MKRYFQFEELGTNYRREMIGGLTTFLSMAYILIVNPLTLSLASVENFPDALRMDQSAVFTATAVAAAVGCFIMGLLAKYPIALAPGMGLNAFFAFSVILNMQIPWQTALSGVMVSGLIFIVLSLSGLREKIINSIPYELKMAVGAGIGLFIAFVGLQGSKIVVSNPDTIVSFGNIHSGPVLLTVFGLIITVILMVLRVNGGIFFGMLITAIVGMIFGQIDVPDKIVGAVPSLAPTFGQAFIHLHDIFTVQMLVVILTFLFVDFFDTAGTLVGVASQAGLMKDNKLPRAGRALLADSSATVAGAILGTSTTTAYVESSAGVAAGARSGFAAIVTGVLFLLSLFFSPVLSVITSQVTAPALIIVGVLMVANLNKIDWTKFEIAVPAFFTMIAMPLTYSIATGIAIGFIFYPITMIFKGKAKEIHPIMYGLAVVFILYFIFLK

SEQ ID NO: 4835 - protein, 252 aa, Bacillus licheniformis
MIEEHHKRNEDDIEQEPASRMSRNSRKKAKKSKETNPSAAKVKSVMESVIAALFRYFSFVLDILKSPVRTALDYDRSYFKYSVISMTLLAVFFSLGNFYQLLAGRGRILGFGVSVPFMEVFLGVFIYCMAFMFWMAAASWAVSNFMLRYKASFFDITAKYGSLLVPFIVPAALWMIFAIINFTAATVILSIVIFMGLTFGTFTLIQSIYEKSEKPRFDLMYCVFTVFLLELVFVGATWKLVGGYLLSSLIPV

SEQ ID NO: 4836 - protein, 184 aa, Bacillus licheniformis
MLHSALLNGVIMVGIILVINIIYVTFLTLRMILTLKGQRYLAAFIGTIEMLVYVVGLGLVLDNLNQIQNVIAYAVGFGIGIIVGTKIEEKLALGYITVNAITKELDLDLPKQLREKGYGVTHWVVGGLEGDRTAMQILTPRKYELQLYETIKSIDSKAFIISYEPKTIHGGFWVKAVKKRRIKE

SEQ ID NO: 4837 - protein, 65 aa, Bacillus licheniformis
MTKPKKKRFEVTEGETIETVLTKMQEEGYTPVRRMEEPVFKETKENGTIQVVPCGRKIIFEGKLL

SEQ ID NO: 4838 - protein, 162 aa, Bacillus licheniformis
MQPLLGVIMGSTSDWETMKHACGILDELGIPFEKKVVSAHRTPDLMFEYAEKARERGLKVIIAGAGGAAHLPGMVAAKTTLPVIGVPVQSKALNGLDSLLSIVQMPGGVPVATVAIGKAGAVNAGLLAAQILSAFDKELAERLDERRESIRQTVLESSDQLV

SEQ ID NO: 4839 - protein, 380 aa, Bacillus licheniformis
MYKQTIFPGATIGIIGGGQLGKMMAVAAKQMGYKIAVVDPVPSSPCGQVADLEITASYNDGEAIRKLAEASDVITYEFENIDYDALNWLKEHAYLPQGSELLLLTQNRETEKKAIASAGCKVAPYRIIHDRAELEASVAELGLPAVLKTCRGGYDGKGQHVLKEQAQIGEAAALLQHGTCILESWVPFKMELSVIVTRSVHGETTVFPAAENIHKQNILFQSIVPARVDEAIQEQAAALALRLAEKLQLVGTLAVELFLKEDGGLLVNELAPRPHNSGHYTLDLCETSQFEQHIRAVCGLPLGKTDLLKEGMMVNLLGDEVYMAEEDPELLKEAKLYIYGKHEVKPGRKMGHITFLRTPDNEWIGQMTEKWIERDGGRKQ

SEQ ID NO: 4840 - protein, 431 aa, Bacillus licheniformis
MIERYSRPEMAAIWTDENRFQAWLEVEILACEAWAELGVIPKEDVKVLREKASFDINRIFEIEQDTRHDVVAFTRAVSETLGEEKKWVHYGLTSTDVVDTALSYLLKQANEILLKDIERFIDILKEKAKEHKYTVMMGRTHGVHAEPTTFGLKLALWYEEMKRNLERFKQAKEGIEVGKISGAVGTYANIDPFVEQYVCEKLGLKAAPISTQTLQRDRHADYMAALALVATSIEKFAVEIRGLQKSETREVEEFFAKGQKGSSAMPHKRNPIGSENMTGMARVIRGYMLTAYENVPLWHERDISHSSAERIILPDATIALNYMLNRFGNIVKNLTVFPENMKRNMDRTLGLIYSQRVLLALIDTGMAREEAYDTVQPKAMEAWEKQVPFRQLVEAEEKITSRLSPEQINDCFDYNYHLKNVDYIFERLGLA

SEQ ID NO: 4841 - protein, 238 aa, Bacillus licheniformis
MNIVKNELLYEGKAKKIYRTDDDNTLFVEYKNSATAFNGEKKAEIDGKGRLNNEISSLIFTRLHEKGINNHFVERISETEQLIKKVTIIPLEVVVRNVVAGSMSKRLGIPEGTELGQPIIEFYYKDDALGDPLITEDHIRILKAAEPEQVEKIKSITRQVNEELQTIFAACDVRLIDFKLEFGLDKDGEVLLADEISPDTCRLWDQETNEKLDKDVFRRNLGGLTDAYEEIFKRLGGM

SEQ ID NO: 4842 - protein, 84 aa, Bacillus licheniformis
MYKVKVYVSLKESVLDPQGSAVQHALHSMSYKEVQDVRIGKYMELTIEKSDRDLDVLVKEMCEKLLANTVIEDYRYEVEEVVAQ

SEQ ID NO: 4843 - protein, 227 aa, Bacillus licheniformis
MKFAVIVLPGSNCDIDMFHAIKDELGEEAEYVWHTETSLDEYDGVLIPGGFSYGDYLRCGAIARFANIMPAVKKAAEEGKPVLGVCNGFQILQELGLLPGAMRRNKDLKFICRPVELIVQNNETLFTSSYGKGESITIPVAHGEGNFYCDEETLAGLQENNQIAFTYGTDINGSVADIAGVVNEKGNVLGMMPHPERAVDSLLGSADGLKLFQSIVKNWRETHVATA

SEQ ID NO: 4844 - protein, 742 aa, Bacillus licheniformis
MSLLLEPSQEQIKEEKLYQQMGVSDDEFAMIESILGRLPNYTEIGIFSVMWSEHCSYKNSKPILKKFPTKGERVLQGPGEGAGIVDIGDNQAVVFKIESHNHPSAIEPYQGAATGVGGIIRDVFSMGARPIAVLNSLRFGELTSPRVKYLFEEVVAGIAGYGNCIGIPTVGGEVQFDGCYEGNPLVNAMCVGLINHEDIKKGQAKGVGNTVMYVGAKTGRDGIHGATFASEEMSDQSEEKRSAVQVGDPFMEKLLLEACLEVIKSDALVGIQDMGAAGLTSSSAEMASKAGSGIEMNLDLIPQRETGMTPYEMMLSESQERMLLVIERGREQEIIDIFDKYDLEAVAVGHVTDDKMLRLFHNGEMVAELPVDALAEEAPVYHKPSKVPDYYKEFLETDVPAPKVEDAKETLLELLKQPTIASKEWVYDQYDYMVRTNTVVAPGSDAAVLRIRGTKKALAMTTDCNARYLYLDPETGGKIAVAEAARNIVCSGAEPLAVTDNLNFGNPEKPEIFWQIEKAADGISEACNVLSTPVIGGNVSLYNESNGSAIYPTPVIGMVGLIEDTEHITTQHFKAAGDLIYVIGETFPEFAGSELQKLTEGKIYGKAPAIDLEVEQSRQKALLKAIRSGLVQSAHDVSEGGIGVALAESVISSQRLGAHVTLAGEPALLFSETQSRFIVSVKKDHQEAFEKLVKDADLIGEVTSDSVLAVQSQEGQQWIHAQTEELESAWKGAIPCLLKSKA

SEQ ID NO: 4845 - protein, 476 aa, Bacillus licheniformis
MLAEIKGLNEECGVFGIWGHEEAPQITYYGLHSLQHRGQEGAGIVATDGEKMSAHKGQGLITEVFQNGELKKVKGKGAIGHVRYATAGGGGFENVQPFLFHSQNNGSLALAHNGNLVNATQLKQQLENQGSIFQTSSDTEVLAHLIKRSGHFELKDQIKNALSMLKGAYAFLIMTEKEMIVAHDPNGLRPLSVAMLGDAYVVASETCAFDVVGATYLRDVEPGEMLIINDEGMKSERFSININRSICSMEYIYFSRPDSNINGINVHSARKNLGKKLAEESGIEADVVTGVPDSSISAAIGYAEATGIPYELGLIKNRYVGRTFIQPSQSLREQGVRMKLSAVRGVVEGKRVVMVDDSIVRGTTSRRIVTMLREAGATEVHVRISSPPIAHPCFYGIDTSTHEELIASSHSVEEIRQEIGADTLSFLSIEGLLSGIGRQYEGENCGQCMACFTGKYPTEIYQDTVLPHVKEIVLTK

SEQ ID NO: 4846 - protein, 346 aa, Bacillus licheniformis
MSESYKNAGVDIEAGYEAVKRMKKHVERTKRIGAMGGLGGFGGMFDLSELPYKQPVLISGTDGVGTKLKLAFAMDKHDTIGIDAVAMCVNDVLAQGAEPLFFLDYLAVGKADPVKIEEIVKGVAEGCVQSGSALVGGETAEMPGLYTEDEYDIAGFSVGAAEKDGIVTGENISEGHLLIGLSSSGLHSNGFSLVRKVLLEDAGLNLDETYAPFERPLGEELLEPTKIYVKPVLEAVKSGKIAGMAHVTGGGFIENLPRMMPDGLGVEIDIGSWPVPPIFPFIQEKGGLKSEEMFNVFNMGIGFVLAVKEEDMTDVIQTLENNGEKAYLIGRVKAGSGVVFGGAGLS

SEQ ID NO: 4847 - protein, 195 aa, Bacillus licheniformis
MKKFAVFASGSGTNFEAIERRMREENWDAEIVLVVCDKPDAKVLERAEKAGIPSFAFQPKSFDNKAAFEQVIVEQLRLHGAEWIVLAGYMRLIGDTLLSAYRNKIINIHPSLLPAFPGIDAVGQAYRAGVKVAGITVHYVDEGMDTGPIIAQRAVELEKSETLASLEEKIHKLEHELYPEVIKELLELNGRGEKE

SEQ ID NO: 4848 - protein, 512 aa, Bacillus licheniformis
MTIKRALISVSDKTNIVPFVKELTELGVEVISTGGTSKLLQENGVDVIGISEVTGFPEIMDGRLKTLHPNIHGGLLAVRGNEKHMAQLNEQGIQPIDLVVVNLYPFKETVSKEDVTFEEAIENIDIGGPGMLRAAAKNHQDVAVIVDPRDYSPVLNDLKENGSVSLEKKRELAAKVFRHTAAYDALIADYLTNVTGEKEPEQFTVTFEKKQSLRYGENPHQEAVFYQSALPVKGSIASAEQLHGKELSYNNIKDADAALQIVREFTEPAAVAVKHMNPCGVGTGNTIEEAFNKAYAADETSIFGGIIALNREVDKATAETLHKIFLEIIIAPAFSQEALDILTSKKNLRLLTLDVNQPVKNEKQLTSVQGGLLIQDLDMHGFDDADITIPTKREPTEQEWADLKLAWKVVKHVKSNAIVLAKDDMTIGVGAGQMNRVGSAKIAIEQAGEKAKGSALGSDAFFPMPDTVEEAAKAGVTAIIQPGGSVRDEDSIKKADEYGIAMVFTGIRHFKH

SEQ ID NO: 4849 - protein, 422 aa, Bacillus licheniformis
MNVLIIGRGGREHTLAWKAAQSPLVGTVYAAPGNDGMAGTAVLVDLDEGNHEGLLAFAKENNIGLTIVGPEVPLIEGLVDAFEEAGLPVFGPSKNAAVIEGSKQFAKDLMKKYQIPTAEYETFTSFENAKAYVEEKGAPIVIKADGLAAGKGVTVAMTAEEAVQCLHDFLEDEKFGEASASVVIEEFLSGEEFSLMAFVKGEKVYPMVIAQDHKRAFDGDKGPNTGGMGAYSPVPQISDAVVEDAVKTILEPAAEAMVKEGRSFTGVLYAGLMLTEKGTKVIEFNARFGDPETQVVLPRLESDLVQVLVDLLADREVELKWKDTAAVTVVLASDGYPESYEKGAPIGTLEPDMEQTVVFHAGTKKSGDQFVTNGGRVANVTAFAETFDAAREAAYQAVDRVRKPGLFYRMDIGSRALKAAQK

SEQ ID NO: 4850 - protein, 199 aa, Bacillus licheniformis
MIEEAAELADSYRGDKRITKSKTNLKKALFELLAEKEWGKISVQDITQRANLNRTTFYQHYQDKYDLLHQHMRDMFEAMKEDIFSPLDIDSSGKKPEAYWYVLRFYHHLQQNSGDFAIIINRRYELNIKELLNDFWNDSFLTGIKKTAAADTDRSVPLDIQRRFVISAFAGTAAWWLENGMPYPPELMAESMIKIIQKN

SEQ ID NO: 4851 - protein, 407 aa, Bacillus licheniformis
MSQTKQQNPIQKALINGKNRQDPYDPFPWYKKMRTESPIHYDEDSKVWSVFRYDDVKRVISDKDFFSNQFPQLGTGNTFAKTMISMDPPKHTRIRSIVNKAFTPRVMKEWEPRIRELTNQLLADVRGREEIDLVQDFSYPLPVIVISELLGVPLVYKHHFKEWSDLLVSLPKSDRPEDVNEWKNIRDQGEEELTAFFEKMIEEKRQNLGNDLISLLIKAEQEGDKLSPDELVPFCNLLLMAGNETTTNLVSNAVYSILETPGVYDELARHPELIPQAVEEAVRFRAPAPMIVRFVKQDTEIRGVSLKKGEGVIAFLASANRDETKFERAHEFDIHRHPNPHIGFGHGIHFCLGAPLARLEAAIAIEALLKQYASMEKLAVVPMADSSMYGLKHFRLRVKSAGETAPN

SEQ ID NO: 4852 - protein, 36 aa, Bacillus licheniformis
MSKLGKWLKRELVKKGLPLAKEKLIPILKEKMKKKR

SEQ ID NO: 4853 - protein, 148 aa, Bacillus licheniformis
MKRILIVLAGIGLLGAGGCGMLDQVNDGLNYTNEAAGYIQKVKTFAEEAPSLAEQAVNDTGAKEKLETQLESIQQAAADFNELTPPDAAAEVHNTIEKHNETLQKSAEDVLKSVEEGKLTVEKLEQSELVQSAQQISDVMGQIEKLTE

SEQ ID NO: 4854 - protein, 138 aa, Bacillus licheniformis
MLPKHSKDQRKQLEVVALSELVPEDQLVRKMEEAMDFSFIYEKVAPLYSSKARPSIDPVVLIKMVLIQYVFGHRSMRETIERVFADLKHKRGLRWTTLRGKKKLSMQAMLVFAAMNLKNWRIGRGKALIASLFIEKTK

SEQ ID NO: 4855 - protein, 76 aa, Bacillus licheniformis
MKQNIGLFDAVFRIACGLTILSAAAAKFTRKPWCRMTLFCMFMGAMKAASGILRFCPMTYVCQTYMKQQGETGEQS

SEQ ID NO: 4856 - protein, 579 aa, Bacillus licheniformis
MSERTLIWKNKHIRSQVDVVSSRLQPTLLLRNASVLNPYVKQWIPANVWIHHDRIVYVGRDLPKTAVKTTIDCEGKYIVPGYIEPHVHPFQIYNPQTLAEYVSQFGTTTFVNDNLFLLLHCGKKKAFSILEELKKQPVHYYWWSRYDLQTEVLNEDQILSIDYRKHWGEHPDVIQGGEMTGWPRLLDGDDLILHCMQCTKRRRKRIEGHFPGASEKTLTKMKLFGADADHEAMTGKEVLKRLELGYHVGLRQSSIRPDLRKILRELHEEGFHHYDHMFYTTDGATPNFYKEGMTNKLIEIAIEEGVPLIDAYNMASFNIAKYYHMEDILGVVAPGRYATLNILNSPDEPNPETVLAKGRLIKSGGINMNAFSVPDWQKGGLVPLNLSYDLTMDDLQFSMPLGLKMRNSVIMEPYTIEIDNSVNQLSFDHDESYLSLFDKYGKWRVNTMLKGFATRIQGFVSSYSTTGDIIAIGKNKEDMLLAFKRMKEIGGGIVLAENGKILHEIPLHLSGGASIETYEKVLEREKALKELLFERGYTFDDPIYTLLFLQSTHLPYIRVTPKGIFDVMKKTVLFPSIMR

SEQ ID NO: 4857 - protein, 329 aa, Bacillus licheniformis
MVNRYVRVLLCFASLLLLASCQSQEQQEKEKNIHPLTGLKADGDIRQRPIAVVVNNHSKARPQSGLSKADIVIEALSEGPITRLLAIYQSDMPEAVGPVRSAREYFIDLALGFDSILVHHGWSPGAKDRLLNGDADHINGMDHDGTLFWRADFREAPHNSYTSYKNVKQAADDKGYAIETRTEPLTFKASPDKPSDALYSIRLDYGTKSVTNRVEYGYDKKVEGYVRKSDGVLTTDLETEEPVVLQNILIAEAEHHMKDAYGRRDIDLRSGGKGLLLQNGEVHRISWKNENGRIIPTADGKTVPFVPGKTWINIVPDLSKVSISKGEGV

SEQ ID NO: 4858 - protein, 103 aa, Bacillus licheniformis
MQIDKLRGRELDQLFQSILSLKDLEECYRFFDDLCTINEIQSLAQRLEVARMLRDGNTYHKIETETGASTATISRVKRCLNYGNDAYIMALDRVKANQSESSS

SEQ ID NO: 4859 - protein, 228 aa, Bacillus licheniformis
MYDITEWKHVFKLDPNKDITDDQLEQLCESGTDAVLIGGSDHVTEDDVLRLMSKVRRFLVPCVLEVSTIDAIVPGFDLYFIPTVLNSRDTDWIAGLHKKAMKEYGELMSPEEIVVEGYCILNQDCKAAALTNADTELDIEDIKAYARVAEHLFRLPVFYLEYSGMLGDSETVKETKAVLQETTLFYGGGIKDAETAVKMAEHADVIVVGNAIYENFEEALKTVQAVKG

SEQ ID NO: 4860 - protein, 739 aa, Bacillus licheniformis
MNYISDQLLSGLNKMQQEAVKTTDGPLLIMAGAGSGKTRVLTHRIAYLMAEKRVAPWNILAITFTNKAAREMKERVESILGPGADDIWISTFHSMCVRILRRDIDRIGINRNFSILDTSDQLSVIKGILKERNIDPKKFDPRSILGSISSAKNELIAPEEYEKTAGGFFEQVVSDVYKDYQKKLRKNQSLDFDDLIMTTIVLFDRVPEVLEYYQRKFQYIHVDEYQDTNRAQYLLVKKMAQRFQNICVVGDSDQSIYRWRGADIANILSFEKDYPNASVILLEQNYRSTKRILNAANEVIQNNSNRKPKNLWTENDEGAKISYFRGDNEFGEGQFVAGKIRELVGSGKRSFSDIAILYRTNAQSRVIEETLMKANINYNIVGGTKFYDRKEIKDILAYLRLVANPDDDISFARIVNVPKRGVGATSVDKIAAYADMNGMSLFEALGQVDFIGLSARAANALDEFRQTIENLTNMQEYLSVTELTEEILEKTEYREMLKAEKSLEAQSRLENIDEFLSVTKNFEQQSEDKSLVAFLTDLALIADIDQLDQKEEETGNQDAVILMTLHAAKGLEFPVVFLMGLEEGVFPHSRSLMEEAEMEEERRLAYVGITRAEEELYLTNARMRTLFGRTNMNPESRFIAEIPEELLDNLNEKKKDLKTPFGRKPERRGPVTRPAASYSKTGGDGVNWAVGDKASHKKWGVGTVVSVKGSGESTELDIAFPSPTGVKRLLAAFAPIEKQ

SEQ ID NO: 4861 - protein, 667 aa, Bacillus licheniformis
MEKEAAKRRVEQLHALINKYNYEYHTLDDPSVPDSEYDKLMKELIALEEEHPDLKTPDSPSQRVGGAVLDAFQKVQHKTPMLSLGNAFNEEDLRDFDRRVRQAVGDVEYNVEFKIDGLAVSLRYENGVFVRGATRGDGTTGEDITENLKTIRNIPLRMKRDLSIEVRGEAFMPKRSFELLNKARIERDEEPFANPRNAAAGSLRQLDPKIAAKRNLDIFVYSIAELDEMGVETQSQGLDFLDELGFKTNHERKKCSTIEEVIEIVEELKTKRADLPYEIDGIVIKVDSLDQQEELGFTAKSPRWAIAYKFPAEEVVTTLLDIELSVGRTGAVTPTAILEPVKVAGTTVQRASLHNEDLIKEKDIRLLDKVVVKKAGDIIPEVVNVLVEQRTGKEKEFNMPKECPECGSELVRIEGEVALRCINPECPAQIREGLIHFVSRNAMNIDGLGERVITQLFREDLVHNVADLYKLTREQLINLERMGEKSTDNLLNSIEKSKKNSLERLLFGLGIRFIGAKAAKTLAMHFETLDKLKKATKEELIEVDEIGDKMADALVTYFEKEEILKLLDELEELGVNTVYKGPKKAAAEASDSYFAGKTIVLTGKLSEMSRNDAKAEIEALGGKITGSVSKKTDLVIAGEAAGSKLAKAEDLNIEVWDEARLISELKK

SEQ ID NO: 4862 - protein, 396 aa, Bacillus licheniformis
MKKILCLAAAAGMLMLSACAPNFGGEEEQEMVQKTDKSKEKAIIPKYNISDSYYKMVLPFKAGKARGLTTERLNTRLDIDEFETGMMRLAQDSFSTDDYLFQEGQYLDEDTVSSWLARKKTGDDLKKAEKDDKNFKNLGLNPALSGSGSTEKQNEESPIYLAHMLEHDYLVRKDKDTIELGGVVIGLALNSVHYYRENVGDPQKEVTISDKKLRQEGEKIAEEVAKRIRNMDDLKNIPLTIMLYKQAPKSSIVPGNFIAKTDVKAGTSEIGGWDKINEEYTFFPSTEGSEKHPDDAELFKRFKNKVDTYFPNYTGVVGTALYKDDQMQDMKINIPMQFYGKSEVIAFTQFLTGEVMDYYGKSGLNVEININSSAGQEAVILKKPGDKEPTVHIYDS

SEQ ID NO: 4863 - protein, 308 aa, Bacillus licheniformis
MWEKFYSKNGLAAKNIAKELMNIKAGEKIPRISDYCHKLSIGRGTVQSALNLLVDMKAIQLEARGHLGTFLVSKDNNLLLEIAGIAPLIGSMPLPYSRKYEGLATGIVEGFESTGKTVNLIYMRGGVNRIEAVRTKRSDFAIVSKMTADHIIAEYPNLKIFKKFGESSYVSSHKIFLAHPDEEIGKDGVRVGVDLESLDQKQLTLAEFENKNAEFVNVNYMQLFDMLLSKQIDAAVWNADDKRMIQTFKAIDFFSPKAKKISKDTTEAVIVIEGDREKEIAEKWNLVNEKQILDTQKSVEKGEKIPRY

SEQ ID NO: 4864 - protein, 121 aa, Bacillus licheniformis
MNQIQLEEKLSILLTSRVITKNAFNTTLNTFVFLSEKLKKEVIKDSEMFWTHMAMALTRIKEGESEEVPANAIINEMYETPYKSAIEEVIDFIHSLAGLELPEGELVYFYLHLHKVIESNK

SEQ ID NO: 4865 - protein, 154 aa, Bacillus licheniformis
MVRIVIGGQLKKQAIEKLVKEIGGNNVEVLVKGDLDAVMAVKNNKADYYIGACETGSGGALAMAIALLGKDKCVTLASPSTIKNKEEIEKEVESGKIAFGFTASTSQNILNILIPLFIKISELFQYIFCYTGLNFFQLRKALSWMLEIKEAWMT

SEQ ID NO: 4866 - protein, 433 aa, Bacillus licheniformis
MDLSLIQCLVIAAVGALGSILVNRGVAVFNDGLRPIMPEYLEGRMTRGELAATSFALSFGLIIGFGIPLSIGATIIIGHSILLACDIIGIWTPENKIGMATAGVIGAVYSIGIVLGLQFVVDLFGKFPVNFIDSLSLIGQPIIIAFTVFPAVAVGYQHGLKKVAVTAIVTLASFLLFEKFGTFQAAGYEISLSPEGMALLAGMLMMIYYAARIRGGDESTNANLVNIFNERVNRIKKNRWLLALMGGLVSLTSSMLILAVDAMPQALINKELYTEAAIATFARGIGFIPLVFSTAIVTGVYGLAGTTLVFAVGLIFRDIPILAFLLGFLVMYLEVISLSAVSKSMDKLPGVREMGEHIRTSLSDVLGMAILIGSAMAGEKIAPGIGFFWVIGFYLINRIASKPLVELAVGPIAVILLGIVANLLYAVGLWQVG

SEQ ID NO: 4867 - protein, 294 aa, Bacillus licheniformis
MLKDGMTYMHEHTTIDLSKVKNNEDCKLDVFPETVREFKSLYEKGVRNIVDVTNIGMGRNITYVQKVAKETGINIVFSTGFYQDSFYPIHVFRESKEKLAERMIMEIVEGIRGTDANAEVIGEIGTSYNKWTETEQKVFEAVVVAHKQTKKPISTHTSIGTLGHEQVEFFKKHEVDLNRVVIGHVDLSGDADYILKMLREGVYVEFDTIGKENYMPDRVRAEILKKIQDKGYIDKVLLSMDITRKSHLVYKGGVGYSYLIDTFIPLLQTYGITGESIDKMLIKNPRAFMKGESE

SEQ ID NO: 4868 - protein, 382 aa, Bacillus licheniformis
MSMDTYPLDSLSIEEAMHRQFKLVDVMTRHFRGEELLSLGDLGVVKGINKPRFTKKIEETLADFFGTEKAMLVRGAGTGALRFGFMSFLKPGDEILVHDAPIYPTSKTTLESMGILPIYADFHDSEQIKEAILKHPKLKGVLIQHTRQKIDDHYDLAETIKKIRSIYSDLVIITDDNYAAMKAEKIGAQLKADLSTFSLFKLLGPEGIGVILGRKNLIEKIEKINYSGGSQVQGYEALEALRGLIYAPVMLAIQASVNDQLVHSLNNGAIKGVKKAYLANAQSKVLLVEFVKPIAEKVLHHANELGAAPHPIGAESKYEFAPMFYRVSGTFLSADPSLAKKMIRINPLRSGPETILRILNTSVHRATEDLSVNSSKGDDINE

SEQ ID NO: 4869 - protein, 408 aa, Bacillus licheniformis
MNKRVIIIILDSLGVGYMEDASDYHPSDVGANTFYHILDTVPSLNIPNLEKLGINKILHHPKLKKTDHIASYGVLNLMHQGADSFEGHNEIMGTKPKKTYLAPFAEHLNHVKLALEDQGYKVNIPNSDLPYLLVNDLVVVADNIETDYGQIYNVSAPLDYIPFDEVLKIGRCVRHHVKVNRVIVLGGENVTPEHLQRSVERREDGLIGVNSPKSNVYKQGYQVRHLGFGISPENQLPTLARNRGMEVSLIGKMQDIIYCEGANRFPGVDTEQVMKDIIQEMDRVKKGLIAATVQETDLAGHAQNPVRYANRIEMVDRYLPEILRKMTDQDLLMISADHGNDPTIGHNQHTREKTYLLAYHKKLSPVHIGERKTLSDIAATSADYLGLRNTENGSSFLHLMQKGKEETY

SEQ ID NO: 4870 - protein, 383 aa, Bacillus licheniformis
MFLESTLKYNKKLIEAALSFHQQGIISPNTYVLDLDTVKKNAKVLSEKARKQDIELFFMTKQFGRNPLVAQAIAESGIGKAVAVDPWEAITLSQNGIKIGHVGHLVQIPIHMIPAILELHPDYVTVFSLENAQNINRVAKKMGRKQKVFLRIANKEDYIYKGQEGGFTFEQIVKDIESIEQLEGLEIAGLTSFPCILIQDGLPAVTPNVASMQTVKSFLMERGYKKLEMNMPSATSCATMKLLKENGATQGEPGHALIGTTPIHATKQLAERPAMVYVTEVSHISNHHAYVFGGGFYPRSHMKAALVGTNKDHLKKVQAIEMTPDHIDYYGSLNTVEAKVGDTAIFAFRTQVFVTNAHIAILKNVAEDPELIGVYDSKGNVIE

SEQ ID NO: 4871 - protein, 242 aa, Bacillus licheniformis
MKIIHVSGYEEMSGKSADLMAELIQNSNNPVIGFATGSTPIGLYKCLIKKYRQKEISFRNVTAFNLDEYVGLAKENKNSYHYYMNEKLFKHLDISRRNINIPNGMAEDLEQECLSYDRLVSEKAIDIQILGMGLNGHIGFNEPGTSFKSRTHIVDLDQSTRQANSRFFRSLDEVPTKALTMGIETIMESKRILLLVSGNEKSEALARLLNSTRVSQEFPASILRKHKDVTVMADDAALNKIH

SEQ ID NO: 4872 - protein, 230 aa, Bacillus licheniformis
MDWHIETETLLKLGIATLIGMVIGLERELKNKPLGLKTCIVIAISSCVLTMISIDAAYHFPRSNRIMMDPLRLPAQIISGIGFIGAGVILRKSNDVISGLTTSAMIWGAAGLGVAIGAGFYKEAFVSLIFILISVEFLPWIVGKIGPNRLQEKEIRVRMSLNDKDKLTDILKEMKAKKIRIHSVRIDDMRDNEFPIMETKIMVHKKRYVTDVYYDIKAIDGVVGVKCDTL

SEQ ID NO: 4873 - protein, 493 aa, Bacillus licheniformis
MSVEVFISLGIYFAAMLLIGWYSYRKTSNLNDYMLGGRGLGPAVTALSAGASDMSGWMLMGLPGAMYVTGLSSAWLAVGLTIGAYVNYLVVAPRLRTYTEVANDAITIPDFFENRFNDTTRILRLASAIVIMVFFTLYTSAGMVSGGRLFETAFGLDYKIGLFLTAAVVIAYTLFGGFLAVSLTDFVQGLIMFIALVLVPIVAFTQLGGITPTFNVIEEINPSLLDFFKGTTVISIISFLAWGLGYFGQPHIIVRFMAISSVKELKPARRIAMGWMIISVIGALLVGLTGVAYVHETGTALKDPETIFIGFSKVLFHPLITGFLLSALLAAIMSTVSSQLLVTSSAMTEDFYRTFFRRKASDKELVLVGRLSVLLVAVIAILLSLTPNNTILDLVGYAWAGFGSAFGPAILLSLYWKRMNQWGALAGMITGAVTVLIWILTGLQEKTGIYEMIPGFFLSLIVVYAVSMITNKPAKEARDMFEEMEQTHEEEHS

SEQ ID NO: 4874 - protein, 96 aa, Bacillus licheniformis
MSRISIEEVKHVAHLARLAITDEEAAMFTEQLDSIISFAEELNEVDTENVKPTTHVLQMKNIMREDVPDKGLPVEDVVKNAPDHKDGYIRVPSILD

SEQ ID NO: 4875 - protein, 485 aa, Bacillus licheniformis
MSLFDHKISELKRLIHNKEISISDLVDESYKRIHEVDGKVQAFLQLDEEKARAYAKELDEALDTRDEHGLLFGMPIGIKDNIVTKDLRTTCASKILENFDPIYDATVVERLHEAEAVTIGKLNMDEFAMGSSTENSGFKKTKNPWNLETVPGGSSGGSAAAVAAGEVPFSLGSDTGGSIRQPASFCGVVGLKPTYGRVSRYGLVAFASSLDQIGPITRSVEDNAYLLQAISGVDKMDSTSANVDVPDYLSALTGDIKGLKIAVPKEYLGEGVSEEAKQSVLEALKVLESLGATWEEVSLPHSKYALATYYLLSSSEASANLARFDGIRYGYRTDNADNLIDLYKQTRSEGFGNEVKRRIMLGTFALSSGYYDAYYKKAQKVRTLIKKDFEDVFANYDVIIGPTTPTPAFKIGEKTSDPLTMYANDILTIPVNLAGVPGISVPCGFANGLPLGLQIIGKHFDESTVYRVAHAFEQATDHHKAKPEL

SEQ ID NO: 4876 - protein, 476 aa, Bacillus licheniformis
MNFETVIGLEVHVELKTKSKIFSSSPTPFGAAANTQTSVIDLGYPGVLPVLNKEAVNFAMKAAMALNCEIATDTKFDRKNYFYPDNPKAYQISQFDKPIGENGWIEIEVGGKTKRIGITRLHLEEDAGKLTHTGDGYSLVDYNRQGTPLVEIVSEPDIRTPEEAYAYLEKLKSIIQYTGVSDCKMEEGSLRCDANISLRPIGQEEFGTKTELKNLNSFAFVQKGLEHEEKRQAQVLLSGGVIQQETRRYDEASKTTILMRVKEGSDDYRYFPEPDLVELYIDDEWKQRVKDSIPELPDERRKRYIEELGLPAYDAKVLTLTKEMSDFVEAAVEKGADAKLASNWLMGEVSAYLNAQQKELADVELTPEGLAGLVKLIEKGTISSKIAKKVFKELIEKGGDAEKIVKEKGLVQISDEATLRKLVTEALDNNPQSIEDFKNGKDRAIGFLVGQIMKASKGQANPPMVNKLLLEEINKR

SEQ ID NO: 4877 - protein, 100 aa, Bacillus licheniformis
MERKDVPEWILALEEEDVEFIKNFMLKSGSLKEIAKSYQVSYPTVRVRLDRLIQKIQLIDELENETFVNFIKQLAIDDQISLENAKLIIEKYKKERGVHK

SEQ ID NO: 4878 - protein, 93 aa, Bacillus licheniformis
MNPIYILLIGFTILGIQYFLSTRNHTFWGAILPTAYIVFLVALSIYEGKSFASFFLPLIGGLALLLGEWIKGREALKKKREREMRIMKAMDIK

SEQ ID NO: 4879 - protein, 247 aa, Bacillus licheniformis
MIAYWKSGGIPQISMHLANPAFTSGHYKTQISNSQYERILDSSTPEGKRLEAMLSKIADGLQELENEGVPVLFRPLHEMNGEWFWWGLTQYNQKDSERISLYKQLYVKIYDYMTKTRGLDHLLWVYAPDANRDFKTDFYPGASYVDIVGLDAYFDDPYAIDGYEELTSLNKPFAFTEVGPQTTNGGLDYARFIHAIKEKYPKTTYFLAWNDEWSPAVNKGADTLYLHPWTLNKGEIWDGDSLTPVVE

SEQ ID NO: 4880 - protein, 113 aa, Bacillus licheniformis
MKKNIVCSIFALLLAFAVSQPSYAHTVSPVNPNAQPTTKAVMNWLAHLPNRTESRVMSGAFGGYSLDTFSTAEATGSNRQQDSCRPYTAAIMQEDGWSRKRSPIRLTTAATVI

SEQ ID NO: 4881 - protein, 282 aa, Bacillus licheniformis
MTEKEEKIIKAGLHLFAKNGFASTTIQDIANECNISKGAFYLHFKSKEALLLAIIKYYIDRMMENMKIIQQKNFPPKETFKEQIAYQFSESKEHRDFILVMISEHSIPENSKIEEYFKNVSQKFHETYQNALSAAYGDIVKPYLSDLSVIVQGIVQSYQNLFIFNELDIDFYELADFIMRRIDDMIDGMVQNGEQPILAGRTYSYYRNAGNTADKHTILRELEDAKRQPELSEDILITLDVIEEELRKDSPRAPVLQGMLTNLQHQDNVQHLYGMITRFLHS

SEQ ID NO: 4882 - protein, 1052 aa, Bacillus licheniformis
MNSIINFVLKNKFAVWLMTIIVTVAGIYAGLNMKQESIPDVNMPYLTISTTYPGATPSQVADEVTKPVEQAVQNLDGVSVVTSTSYENASSVMIEYDYEKDMDKAKTEAAEALANLDLPDNAKEPSISRYSMNSFPILALSVSSDKDDLQSLTKKVEDSLLTKLEGLEGVASVQLSGQQVEEVEFSFKKDKLKQYGLDEDTVKQVIQGSDVTTPLGLYTFGKEEKSVVVSGDIDTIKDLKNMRIPAASAGGASAQAGAQSAQAAQGAQAQAGAQSAGQAQQSAGVPTVKLSDIATIKDVKKAESISRTNGKDSIGISVIKANDANTVEVADNVKAELEQFKKDHKGFKYSSTYDQAEPITESVETMLSKAIFGAIFAVVIILLFLRDIKSTLISVISIPLSLLIALLVLNQLDITLNIMTLGAMTVAIGRVVDDSIVVIENIYRRMRLKDEPLRGKALVREATKEMFMPIMSSTIVTIAVFLPLALVGGQIGELFMPFALTIVFALAASLLIAITLVPMLAHTLFKKSLTGAPVKAKEHKPGVLANFYKKVLNWSLSHKWITSIIAVLMLVGSLFLVPLIGASYLPATKEKMVQITYTPEPGETKKEAEKEAQKAEEILLDRKHVDTVQYTLGAGNPLMGGSSNGALFYIKYEEDTPDFDQEKDSVLKDIQKQSKRGEWKTQDFSSSGNNNELTYYVYGDSEKEIKGTVKEIEKIMKDQKDLKNVSSGLSSTYDEYTFVADQEKLSKLGLTASQISQALMKETSQAPLTTVKKDGKDLDVTIKTEEETYKSVKDLEDKKITTPTGQEVKIGDVAKVKEGTTSDTISKRDGKIYADVTAEVTSDNVTAVSVDVQKNIDKIDLPDNVTIDTGGVSADIEDSFTKLGLAMLAAVAIVYLVLVITFGGALAPFAILFSLPFTVIGALVGLYVSGETISLNAMIGMLMLIGIVVTNAIVLIDRVIHKEAEGLSTREALLEAGSTRLRPILMTAIATIGALIPLALGFEGGSQVISKGLGVTVIGGLISSTLLTLLIVPIVYEVLAKFRRKKPGMEEE

SEQ ID NO: 4883 - protein, 179 aa, Bacillus licheniformis
MIKKGTNIYIRPLTAEDAEACLELQNANRPFFEQFSMERNEEFYTIEGQKKRLQRLYENMENDEDYYFGIFDPANDALIGTINLFQVLRGSLQSAFIGYFLDQKHNGKGYTTEAVKLMVEFAFHDLKLHRIEAGVMPRNIASIRVLEKAGFHKEGIARKNVKDQRKMGRSSAAGCDQSA

SEQ ID NO: 4884 - protein, 317 aa, Bacillus licheniformis
MKKPVYFNHDGGVDDLVSLFLLLQMENVKLIGTSVIPADCYLEPALSASRKIIDRFGSYQVETAASDSRGVHPFPKEWRMHAFYVDALPILNEKGEVRTPVSELPAHLHLIECVRQSPEPVTLLFTGPLTDLARALEEEPAIIKHIAKLVWMGGTFLEKGNVEEPEHDGTAEWNAFWDPYSVKTVFESDIQIEMVALESTNQVPLTNEIRSHWASLRKHIGIDFIGQCYAMCPPLVHNETNSTYYLWDVLTTLTLGTVDMTRSRSIKAVVHTQSPRQGTTEEHPDGRMVKVVDQVDRDQFFAYFEELMKRADRIPSL

SEQ ID NO: 4885 - protein, 304 aa, Bacillus licheniformis
MKRARIIYNPTSGREIFKKNLAQVLQKFEQAGYETSCHATTGEGDAVQAARHAAEREFDLIVAAGGDGTLNEVINGLAPLEHRPKLGVIPVGTTNDFARALGIPREDILKAVDTILEGEARPIDIGRVNGQYFINIAGGGRLTELTYDVPSKLKTMLGHLAYYLKGMEMLLPSLRPTEVEIEYDGKLFEGEVMLFLVMLTNSVGGFEKLAPDSSLNDGMFDLVILKRANLAEFIRLVGLALRGEHINDEHIIYTKANRVKVTVKDKMLLNLDGEYGGELPGEFENLYRHIDVVMSKEKARKLDD

SEQ ID NO: 4886 - protein, 462 aa, Bacillus licheniformis
MKQKAPVQKNEYYNVVFEDLTHEGAGVAKVDGFPIFVPNALPDEKAQIKVTRVKKGFAFGRLIDLKEESRFRTDAPCPIYKQCGGCQLQHINYEGQLLYKQKQVKDVLERIGKLDLSRITVHPTLGMEDPWNYRNKAQVPVGEREGGLIAGFYQQRSHEIIDMNECLIQQSENDRVVQAIKEICGKYGIKAYNEERHKGWLRHIMVRYGAVTGEMMVVFITRTNDFPHKAKIVEEITAAFPHVKSIVQNINPKKTNVIFGDETTVIWGEEYIYDTIGGIKFAISARSFYQVNPEQTKVLYDKALEYAELNGEETVIDAYCGIGTISLFLAKQAKKVYGVEIVPEAIEDAKRNAELNGIENAEFEVGEAEVVIPKWYEEGIAADTLVVDPPRKGCDEALLRTIIEMKPKRVVYVSCNPGTLARDLRVLEDGGYVTREVQPVDMFPHTSHVECVTKLVLKGAVD

SEQ ID NO: 4887 - protein, 189 aa, Bacillus licheniformis
MKLEDIVTVKIGRNLSRGNVKNDHTLVAYTYEDLMNDLDGSFLDSQASFDAGHSNHKESYLSNAGDVVFSFVSSKAGIVSNLNRGKIINQNFAKLMIEHDELDRSYLCYALNESYAMKRQMAISMQGSAVPKLTPAILKELEIKLPSIEKQRIIGKAYFCLRKRQALAKKQAELEEKLFLEVLKQLDQQ

SEQ ID NO: 4888 - protein, 530 aa, Bacillus licheniformis
MAELHSKLFSAADNLRSKMDASEYKNYLLGLIFYKYLSDKLLEKVVEIAGESLEEYNTQDKQTQLYMESLADEEIKNDLIETLVDTLGYDIEPKYLFSVLANQAKQNTFHLNDLNKAFIDLSTKYDQFNGLFDDVDLKSKKLGSDDPQRNITITEVLKKLNDVNVIEHNGDVIGDAYEYLISQFASEAGKKAGEFYTPHQVSDMMARIAAIGQEDKKLFSVFDPTMGSGSLMLNIRNYINYPDSVKYHGQELNTTTFNLAKMNLILHGVNKEDMRLRNGDTLNKDWPTDEPYTFDAVLMNPPYSAKWSADTTFIDDSRFNRYGKLAPKSKADFAFLLHGFYHLKDSGTMAIVLPHGVLFRGAAEGVIRKKLLEDGSIDAVIGMPANLFFGTSIPTTVIILKKNRSTRDVLFIDASKEFIKGKNQNKLSKENIDKIVETYKKREDVEKYAHVATFEEIKENDFNLNIPRYVDTFEEEEPIDMAAIGSKIKDIRIEKAELESSLYDMISSLQYDEENADWIKGALEVFNRGK

SEQ ID NO: 4889 - protein, 397 aa, Bacillus licheniformis
MENKRVPELRFAGFAGDWEERKLGELVEIKSGWTPSDFVETQKCNGEIYIKVDDLNYSTRELLDSKMKVAIHAKYHTIKKGSTIFPKRGAAIMTNKVRILGTDGYMDTNMMALEPRNINGEFLYTLIDRTGLFKIADTSTIPQINNKHVEPYKILLPNLYEQKNIGNFFKQLDDTIALHQQELTTLKQTKQGFLQKMFPKEGESVPEVRFPGFTGEWEQRKADEIFYSVSDKNHSNLPVLSATQEKGMVYRDETGLDINYDVKSTKNYKRVLPGQFVIHLRSFQGGFAFSNIEGITSPAYTVLDFKNKEMYYSLFWRCVLASDTFIKRLEAVTYGIRDGKSISFSDFSTLKFRVPSHNEQLKIGNFFKQLDDTIALHQCELDTLKETKKAFLQKMFV

SEQ ID NO: 4890 - protein, 1052 aa, Bacillus licheniformis
MTKIPHKDEAQVERRLIEVLGEGHNQWNYRPDLKSEEDLWQNLRQKITQNNLSEIGEHPITDKEFDTIKTELLSKTQTPFDAARWLKGENGIARITIEREDVSLGSMSLVLYSNQDIGGGISTYEVVHQIAKQKANLDGRDRRFDVTLLINGLPIVQIELKKVSAKDGVFQAFNQIKKYSEEGMFRNNIFSTLQLFVISNEQTTRYFANAMPKDMHKKFVFSWRTKDNRKVENLYEFVKQVLNIPDAHRLIADYTIVSEDQDNKAVIVLKPYQIHAIQALFTSAMKHQSGFVWHATGSGKTLTSFVSTKLLARKAGVDRTIMLIDRKDLDNQTTTEFTKFASEFNTGISSGDAISNSLIVGTGSAKELSDTLQSDANSNTVIITTRQKLEAALRYAQRQEEQKGTQRFKKLLGQHIVFVVDECHRALSAEGMQVIKGFFPNSTWFGFTGTPIFNENKKQAKGQLARTTRDQYGEVLHTYTIKNALDDGAVLGFQVEHEDTIDPTSLNNYIFNQLRQNEKYANLTADEINNIIDQMDGTEKEAYLEPSSFESDDHIQKVIHKIFRPDNAYTKFDFQNGRPQKSAILTTSSIDMAKRYYRAIKEMMKDSDWLTKEFAGHPIRTGRTIEDPDFPRIAITYSIQENEDNSKQIQDEMKEIIKEYNDYYHTAWSIEDIERYNGDINNRLARKKAEFKEFGKQIDLVIVVDRLLTGFDAPTIQTLFVDRNLSYANLIQAFSRTNRTYPGKTKGLVVTFRKPSTMEQNVKNATKLYSQAQEESSLVYPTYDESKKRFKKAHKALTTLVPNPTDIDENTSLETRIEFVKAFQELNNSYEALVTYNDYNDDMKKSPALQEQVKTLEEYIGIYNTVKGSLEDEGNQDGPGPDFSDIEFYGENAVKIYDIDSTYIDRLLETYSANNQNIRDEIENALQKLKKSEIVKGVYRKMLNAIDANEIDAEEDILAVKRSFFTKARDKAIHEFANTWFVEEDELHLSAIQYVIGINSIPNISKINNSGQFDKYKAVHPDAKPLKYRPEIKRQWKKTLDEVIVPLDDELR

SEQ ID NO: 4891 - protein, 206 aa, Bacillus licheniformis
MQEDGQFLEDRVNEEEYQIAAQTFIISENTNVGYEVSQKRKRPQPIINQGGQRHWTRNASLASKAMMLSNYTCEIDHTHRTFISKSTNMPYVECHHLVPIAKQEGFKYDLDQLANLVSLCPHCHRLIHYGQDEEKEKMLKKLYDQRKDHLKKVGIEITFSELKRIYKYRIFRFKLRALDKRYQGFLMFNIIDKRLLQKFTYVMRSF

SEQ ID NO: 4892 - protein, 621 aa, Bacillus licheniformis
MNYIQTARDVLQHVGGKENIAHLEHCSTRLRFTLIDQNKADVPALEKTPGVIAVRMSGQCQVVIGNDVIEVYEELTGLLGGALSGQNGSSHQPKEKRKVGTVLLDFIVGVFQPLVPAIAGGGILKSFLLLFSLFGFIDAKGQTYQILNMVGDAPLYFLPLLVAVTTANKLKVNPLVALSAVGALILPNMTAMLTEGAQLFSFDVKNIAYAYQVFPVILSVLLYAQMEKWFTRISPKPIRIFFVPMMSLVITVPITLLLLGPIGFTAGQGFTALILAMFDKVGWIAVAILAAVLPFMVASGMHKAMVPYAVTTMGNLGKEALYLPASLAHNIAESGACFAIALRTKDKVLRSTAISAGISAFFGITEPALYGVTLQNKRVLSSVMIGSFIGGIFIGLVGLQAFVLVGPGLASMSMFISDELPRNFMFAVIGFAISFAVAFAAAFILGKDRKTEETEKEAEPGAFAEKLGADETFKSPVIGQMISLSDVEDDIFSSKVMGEGIAIIPSKGELYAPVDGEISLLFETNHALGMKTANGVEVLFHIGIDTVQLEGKFFKPLVQAGDKVKAGDLLIQFDLEKIKEAGYDPVTLAVITNTDQYDIKVTQLKEVNRQDTLMVVTQLGG

SEQ ID NO: 4893 - protein, 489 aa, Bacillus licheniformis
MMTKTKGFPKDFLWGGAIAANQAEGAWNVDGKGPSVADIAMYRSNLSVEDYEGHLAVSSENIERAMKDPDVKKYPKRRGIDFYHHYKEDVALFAEMGFKTLRISIAWSRIFPTGEEAEPSEKGLQFYDRLFQEMKKHNIEPIVTLSHYEMPLALSLKYNGWVERKVIDLFVKFANVCFERYKDVVKYWLTFNEIDSIHRHSFITAGIIPDRCPEGKVEETVYQALHHQFVASALVTADCHRIIPGSQVGCMLTKLTTYPHTCHPSDVERALKQNLDNYFYADVQVFGEYPPLIKRMLERKNINIKMEADDLAIIKEHTVDFVSFSYYMSLTESAQEGLEKTDGNTIRGVKNPYLPSTDWGWQIDPVGLKISLIELYDRYQKPLIIVENGMGAKDVVESDGSIHDDYRISYFREHFRQMKEAIEEGVDLFGYTSWGPIDIISAGTSQMSKRYGFIHVDQDDDGNGTLKRSRKDSFYWYKKVIETNGEVLD

SEQ ID NO: 4894 - protein, 282 aa, Bacillus licheniformis
MFKIKKVLNSSVVLAVDQNRQEMVLCGRGIGYGRKPGNMIEEKQADQVFMPVDNMKAKEFLQLLDSIPQEFIELTQQIVQHAEERLKTKLNSGVYFTLMDHLNFAVERYKKNINITNRVYWEIKNYYTEEFEAGNYALQLINETFGIQLPKEEAANIAFHLINALGEETESKDGMKNAKMIGSIVNLVRYTLNMKLDQENIHYSRFITHVKFFVERFYADKLLANQENELFEQIANLYPQAMDVAFKIKDYIKQVHGNVIPNDELTYLAVHIHRLISYQQLK

SEQ ID NO: 4895 - protein, 370 aa, Bacillus licheniformis
MSKVASEVVAGVLNEFHLAIKKHDTEQAKHLFDEAKSMFSEMEEDQNVLAYFSLLEERYRMMLYDARGERLPRESYFNDSQIECIEQTDHMIDYYFYFFEAMHEAYNKNVERAISLYKVAEKKLAKVPDQIEAAEFYFKVSWLYMSLRQNAVSLNYARDAMNIYKMHDGYEKKLAISQVVMGTNYMQMQRFKDAEKYFEESIEISKKIDDSFLEAMLHHNISILYSNSGRSQECILAVQHALSNAEWCKSSYYINSLYMLTREFFKIGETEAALFYHKKGQEELKKNGNKHYEKKINIIYELYCHENVKSIKDDIHSLDEMNDLDGVCDLSLLISSYFEKKGDDKKALEFVKIFMKAENKMRSLGSEVLS

SEQ ID NO: 4896 - protein, 40 aa, Bacillus licheniformis
MKKLILCLSLTAMVLGGAALSQSHNQASGGVQTAELPVGG

SEQ ID NO: 4897 - protein, 252 aa, Bacillus licheniformis
MNDKTFLSFLKHADKPFSGWDFSFIEDTGRMKSDLLSWSYGSMALSLIQDSESMLDMGTGGGEFLSKLGPFPSSAYATECYLPNVPVAKERLTPLGVQVVQIDDDEDLPFESGQFDLIINKHESYSVQEVRRILSKGGRFLTQQVGGLDCEEINEKLGVPLNEEFKDWDLETALKEMEKHDFKILKSREECPTQRFYDIGALVYYLKAIPWQALGFEVNQYKDELYEIHKMIEEKGYFDVTQYRFMILAEAV

SEQ ID NO: 4898 - protein, 239 aa, Bacillus licheniformis
MGRKWNNIKEKKASKDANTSRIYAKFGREIYVAAKQGEPDPELNQNLKFVLERAKTYNVPKAIIERAIEKAKGGSEENYDELRYEGFGPNGAMVIVDALTNNVNRTAADVRSTFGKNGGNMGVSGSVAYMFDPTAVIGFEGKTADETLELLMEADIDVRDILEEDDAVIVYAEPDQFHAVQEALQNAGITEFTVAELTMLAQNDVALPEDARAQFEKLIDALEDLEDVQQVYHNVDLGA

SEQ ID NO: 4899 - protein, 69 aa, Bacillus licheniformis
MKTLIKEKRTSLNMTQEELAKRLNVSRQTVISLEKGKYKPSLVLAHKLAQIFECLIEDLFIFEGDENID

SEQ ID NO: 4900 - protein, 86 aa, Bacillus licheniformis
MLGIAIVYKVNRRIGKKERLFDERQQKISYQAKALSWNITMAAILIAWALVIIFQGISFSFFLITGLYILQYLSMLITTVYLAQKN

SEQ ID NO: 4901 - protein, 485 aa, Bacillus licheniformis
MIQITDLNRQYIGGEWRDGQSESVLADLNPFTHKTIASFRKATREDVDAAYKAALEAKKKWDGVNPYEKRAILEKAAAYIEDNREAIVFLIMEELGGTRLKAAFEIDLVVNMIKEAAGFPLKMEGKILPSPVDGKENRIYRIPAGVVGVISPFNFPFFLSVKSVAPALGAGNGVVLKPHEETPICGGTLIAKIFEEAGLPKGLLNVVVTDIGEIGDSFVEHPIPRIISFTGSTKVGSYIGQLAIKHFKKPLLELGGNSALIVLEDADLEYAVNAATFSRFTHQGQICMSANRILVQKEVYPEFLKLFSQKVSGLKTGDPLDPETVIGPVINERQAEHLRKSIEKGIEEGATPLLKGDIKGNLVEPTILADVTPDMSVAKEELFGPVVCVMPFETEADAVEIANDTPFGLSGAVHTGNVESGVAIAKQIETGMIHVNDTTINDEPHVAFGGEKQSGIGRLNGEWSLDEFTTLKWISVQHQKRSFPY

SEQ ID NO: 4902 - protein, 283 aa, Bacillus licheniformis
MNEAVKTDIHPLLDAFVKVAPFLNQLIQDDVTVGIYDTEKLIVNIPGKTFSLNVKAGDPLQEGDIITDAIRQNKKKVSMVPKELFGFPLAARAIPLHDENGRVIGGVGLGTSLEKSDQLHRVAESLSVIVEQTASAIQDIAESVSGFSGQMSDISKQAKEVSESAGEIEKISVTVKGISDQSNLLGLNAAIEAARAGESGKGFSVVADEIRKLATHSKENVGQIDQITKKIHALLKDLEHSIEVINEHTSGQAAGVEQISATMQEISSNAQNLAKMAEHQFED

SEQ ID NO: 4903 - protein, 474 aa, Bacillus licheniformis
MRVYTTTKLTGLLLGPISFLLILGLIPEAELAYAPRIVLAVTAWTAVWWITEAVPIPAASLLPVILLPTLGGLDMETTAKAYGDPIVFMYMGGFIIAIAIEKWNLHKRMALHILKRIGAESHRIVLGVMAATAFLSMWISNAATALMMLPVALAVIKEVQEKEILKGESLQKFSKSILLAVAYAASIGGLATLVGSVPNAVFAAMSKQMLNHEIMFFEWFLFGFPVSILFLAILYVYLTKIKFKVSAFQGKKPDFIDHDLKALGAMTREEKSVFTVFLLTACLWMFKFILPFQISDTSIAIFGAVLLFLIPSTKDERILEWKDMQSLPWGLLLLFGGGLSLAAGFSATNLTAWIGGKLKLLEGHPYLFVLIILTAAILFMTEIMSNTAVANMVIPMTIGLGAALQVEPYGLMAAAALASSCAFMLPISTPPNAAVFSSNLLTIKDMVRAGFWLNIAGVFLIVISAYFWLPAVFQ

SEQ ID NO: 4904 - protein, 629 aa, Bacillus licheniformis
MSIFKAEGLYKTYGDKTLFDHISFHIEENERIGLIGPNGTGKSSLLKVIAGHESTEKGDITKPGSLHIEYLDQDPDLDGPETVLEHIYSGDSVMMRTMRTYEQALQELNAAPDDPKKQENLLAAQGKMDEHGAWDANTAAKTILTKLGVADVAKEVSSLSGGQKKRVAIAKTLIQPADLLILDEPTNHLDNETIEWLEGYLSGYPGSVVLVTHDRYFLNRVTNRIYELDRGRLYTYKGNYEVFLEKRAEREALAEQNETKRQNLLRRELAWLRRGAKARSTKQKARIQRVEELKEQDAPETGSSLDFAIGSHRLGKQVIEAEGVDISRGGNQLVRSFNELIVPGDRIGIIGPNGIGKTTLLNALAGRIKPDGGQITIGQTVRIGYYTQDHSEMNDALQVVEYIKETAEVVKTADGQVVTAEQMLERFLFPRSVQRNLIRKLSGGEKRRLYLLKVLMEEPNVLFLDEPTNDLDTETLGVLEDYLEQFPGVVVTVSHDRYFLDRVVDRLLVFEGGGNVSRFQGSYSEYMEKQKENSRQKPASEAAEPVKPEKKKRKKLSYKDQLEWDGIEDRIAALEEKHKRLEEEIAAAGSDFAKIQTLMEEQAQTAEELEAAMERWTELSLLIEELEQS

SEQ ID NO: 4905 - protein, 64 aa, Bacillus licheniformis
MPFEELLSCLLMAALCVLLFIKAMGCRKENRRGSLAFFMMFSIVCLTTLIIKIVKLGHFFGRAF

SEQ ID NO: 4906 - protein, 300 aa, Bacillus licheniformis
MERKLHLPAKPERHRRFGSVEAVKGIKPTDKEQMKDIQNTPNDYFFDIDHVGVSNVSHPILIASSLKPFTQTTIGAFSFTTSLARDRKGINMSRLTEQLQRYHEANWTVDFHTLKDFAKDLAGNMEQESASVSVSFPWYFERISPETKLSGLMHADIHMTVSYHENKGFSQTAGITAHATTLCPCSKEISEYSAHNQRGIIKITAHINEQAEMPDDFKAELLAAAETNASAKLHPVLKRPDEKRVTEQAYENPRFVEDVLRLTAADLYEMDWISAFEIECRNEESIHLHDAVARLSFSKC

SEQ ID NO: 4907 - protein, 370 aa, Bacillus licheniformis
MQHSEIVIVGAGPAGIGMGIVLKKLGFKSFTILEKDRAGASFRSWSEEMKLITPSFTGQGFGALDLNAVAPGTSPAFTFQREHLSGREYGDYLALLADHFQLPIQEGTSVRSVHKDDGGFSVETDKGTMKAKDVIWGAGEFQFPKYSFHGAEIGIHNSKVARWSQFEKAHYYVVGGYESAMDAAVQLASYGSDVTVVMPNSLRENAEADPSRSLSPYTWERLEDAYEKGKVQFLEKAVVEKLAKNGPAYDLYLSDGRKIRSETRPIIATGFHSGAKQIEHLFEWGENGKPLLTNEDMSTVTDGLYLIGPSVQHQNAVFCFIYKFRQRFAVIAEHLLKKRRFSIDEKVLTEYRENQMFLTDLSCCEVQCEC

SEQ ID NO: 4908 - protein, 275 aa, Bacillus licheniformis
MLKEPTRRQRMLFIGLESVGKTTLFSAITDQRAGEAANVKGSTIFAAEREIKSLPGWQAIDTPGIREDGSVSKRALKKEIEKADEVVAVLRGTHFSEELNAVLELIPPEARRVCFIVTFQDKMTDAMRRKLSEQVAKHSLPVLLVDTRTVTDDKKERIIAFLRKEAEFHPLKRRRMKQIELESVAVQQSVFHRPVAGPVVSAALLCLLFMAPIVLAYHTSEWVQQSADKWAVVRSKMRSGACRHGWARHWRGTMACYPLAFTRLFGRFLSFCLCL

SEQ ID NO: 4909 - protein, 336 aa, Bacillus licheniformis
MGAAICGQMGGCPLQNAVGGLPSWLGAALAGNYGLLSLGIYSFVWAFPVVLFMSIANAAADDSGLKDRIVDSLDPLMRKIGLNGRDLVPLLTGFGCNVVAVQQTRSCSMCTRKRCVSFISFGSACSYQIGATLSIFHAAGREWLFIPYLAVLVAAAAVHNRIWYRIDQKWAAYFERRQTFLQKPSWKGIVFRVKEVLQQFIFQAMPIFLIICLAATVLNELGVIRLVTLLVSPVLSLFGAPEDAAPGLVFSLIRKDGILLFNEGNGALLDMLPGATLFLLIYLASTFTPCMVTVWTIAKELGMKTAAAIMGKQMATSVVSVLSIMIIWKLTLCIFK

SEQ ID NO: 4910 - protein, 399 aa, Bacillus licheniformis
MSKKIPVTVLSGYLGAGKTTLLNHILQNRQGLKVAVIVNDMSEVNIDAGLVKQGGLSRTDEKLVEMSNGCICCTLREDLLVEVEKLAKQGNIDYIVIESTGISEPIPVAQTFSYIDEELGIDLTRFCRLDTMVTVVDANRFWHDFQSGDSLLDRKEAVGEEDERDIADLLIDQIEFCDVLILNKCDLVSEEDLQKLEKVLKTLQPKANIIRAVKGEVDPKAVLNTGLFNFDEASGSAGWIRELNQGHHQHTPETEEYGISSFVYEARRPFHTERFYNWIHSLPENVVRAKGIAWCATRNTLALLMSQAGPSVSLEPISYWVAALSKPEQEQILRQNPELLKEWNEEFGDRHTKLVFIGLDLSPSEITAEADRCLLTDSEMAADWSLLSDPFDWQIERAR

SEQ ID NO: 4911 - protein, 230 aa, Bacillus licheniformis
MKGEAYYSVRMRASENGPHEEGGKHISGGERLVPFIGLNDAVSDLLEKGMSHSRGRPDFMQIQFDLVNEPIKLVQPLRIETNETVSAEEGQALARELISRAGVPESAVEKAFQGIAEYWGVRGAVLFDIHSGRRIDGRKEKGVRVSRLDWPEADFQRWAALCGVPPNPRLKEALAIASKVCEHPAVIAELCWSDDPDYITGYVAAKKLGYQRMTKDERAWGRKRLPDFFC

SEQ ID NO: 4912 - protein, 448 aa, Bacillus licheniformis
MNQSFVEKSKQYLWLPFTQMKDYDENPLIIESGQGIKLKDIDGRVYYDGFSSVWLNVHGHRKKELDEAIKKQLGKIAHSTLLGMTNVPATELAEVLIKITPENLTRVFYSDSGATAMEIALKMAFQYWKNIGKPEKQKFISMKNGYHGDTIGAVSVGAIELFHHVYGPLMFESFKVNVPYVYRSKSGNPDECRDECLAELERLLSERHDEIAALSVESMVQGASGMIVMPEGYLAGVRELCTKYDVLMIVDEVATGFGRTGKMFACEHERVQPDLMAAGKAITGGYLPIAVTFATEEIYEAFYDDYNKLKTFFHGHSYTGNQLGCAVALENLRLFESEKIVAQVAEKSKILESLFHDLAALPHVGDIRQLGFMSGIELVQSKETRQPYPPEERIGYRVSLKMRELGMLTRPLGDVVAFLPPLASTADDLRAMVSIMKEAIQEVTGRAY

SEQ ID NO: 4913 - protein, 379 aa, Bacillus licheniformis
MRIDEWLSSRLAKTKAAGLYRSLKLPQAERTNWASNDYLGLANDKRLIHAAETALRRFGAGSTGSRLTSGNTAWHEKLERKIAGFKQTEAALLFSSGYLANVGVLSSLPEKGDVILSDQLNHASIIDGCRLSKADTVVYRHKDMNDLEEKLRAAQSRARRFIVTDGVFSMDGTIAPLDEIMLLAKQYRAFVIVDDAHATGVLGEAGRGTSEYFGVSPDVVIGTLSKAVGAEGGFVAGSKTLIDFLLNHARTFIFQTAVPPASCAAACKALDIIEDSRAKRRLLQSSVNTIKRSLVDIGFTVNGEDTPIIPVMIGDPQKAVQFANGLKEKGIEAPAIRPPTVAEGESRIRLTVTAERRLKDIEDLLEGFKLMGRELNLVK

SEQ ID NO: 4914 - protein, 235 aa, Bacillus licheniformis
MKGFFVTGTDTGVGKTFIACGLAALLKEQHVDVGVFKPFLSGELASDPQSDTALLKNMSETPLTDEEVTPFIFKEPLAPYTAAKLEGRTVGLEDAVNHWKKIKDRHECFIVEGAGGIAVPLGEDYFVSDLIKALDLPAVIVARPNLGTINHTYLTAQYAKQMGIRVIGIVINGISSRPGLDEQTNPDMIERFCGVPLLGVTPKLEDASPTQIHHMIKDHVDVSLIMNQMQMGAEK

SEQ ID NO: 4915 - protein, 333 aa, Bacillus licheniformis
MNQWMELAERVLDGGEVTEKEALSILECPDDDVLLLMHAAFQIRKRYYGKKVKLNMIMNAKSGLCPENCGYCSQSSISKAPIDSYRMVDKTTLLEGAKRAHDLNIGTYCIVASGRGPSNREVDQVVDAVKEIKETYGLKICACLGLLKPGQAERLKEAGVDRYNHNINTSKTNHSNITTSHTYDDRVNTVETAKKSGMSPCSGVIVGMKETKQDVVDMAKSLKALDADSIPVNFLHAIDGTPLEGVNELNPLYCLKVLALFRFINPTKEIRISGGREVNLRSLQPLGLYAANSIFVGDYLTTAGQNETEDHKMLHDLGFEVESVEEMKASLQR

SEQ ID NO: 4916 - protein, 398 aa, Bacillus licheniformis
MTTELHEAGPSLKSDSDFWRDPYLFYDQLRSIHPVYKGTVLKHPGWYVTGYEEAAAILKEPAFINRVPLPEASTKYEQLQRLQRNMMLFQNESGHKRMRTIAGKEFMPQKTATFRPAIEETVHELLDQLENKKTADMVSEFAFPLASLIIAGMLGVPEEEWYQFRQWTADLIQTIDLTRTRKVMAKGGDTVAKLTAYFKNLIEKRKAHPSEDLISTFAGHEQLADEEVLATCILLVIAGHETTVNLLTNGLFLLMTHPDQLSELKENPLLIESAVEECLRYESPTQLTARTASEDCEINGKIIKKGEHLYILLGAANRDPKIFQNPHLFDITRKPNPHLAFGAGAHVCLGSALARLEAQIAIPALLARLPNLKLASTDVPFRRLIGFRSLAELPVILN

SEQ ID NO: 4917 - protein, 276 aa, Bacillus licheniformis
MNTHQNRYSVQSKVSALINCRLFQSFITTVIVLNAISIGLETYAFFKPYQKVFFIVDCLFLTIFVIELSLKLFVQKQHFFKNNWNVFDFVIVAGSLILYNTNFVSVLRIFRVLRVLRTITSVPSLRRIVNALFMAIPTISSVIILMSIIFYVYAVIGTMFFSAIAPEYFGNLQLSLLTLFQTFTLESWASGIFRPIFAESGWSWLYFVSFIVIATFIMINLIVGEIVNNAQKISQEIEDETGELKEDTKEIKELRAEVKELKALLQTYITQNEKKD

SEQ ID NO: 4918 - protein, 140 aa, Bacillus licheniformis
MEWMKIDQMAKRSGLTKRTIRFYEEIGLLSSPKRTEGGVRLYSEDDLEELERVISAKEVLGFSLQELQQFMETGKHLEMNKEGYLLSLDKRERKEKLEDIQRMLNEQMRMIDEKIEKFQSFKKRLEGMQAKAENALQSID

SEQ ID NO: 4919 - protein, 394 aa, Bacillus licheniformis
MNEQPPENSSMFKQPKAVWAVAFACVISFMGIGLVDPILPAIAQQLHASPSQVSLLFTSYLLVTGFAMLLSGAVSSRIGAKLTLISGLILIIVFAGLGGLSHSISQLVGFRGGWGLGNAMFISTALAVIVSVASGGSAKAIILYEAALGLGISVGPLAGGELGTISWRAPFFGVSVLMAAALLAIFFLLPPVQKPQKKISVSAPIKALRYKGLLTLSGAAFLYNFGFFTLLAYSPFVLDLNERGLGYVFFGWGLFLAITSVFIAPAVQRIFGTVRSLILLFMLFAADLLAIGIWTEHMALVIGAIIIAGGILGMINTILTTAVMEAAPVERSVASSAYSSIRFIGGAIAPWIAGVLADHFTAHTPYFAGCIAVLAGIAVLAGGRRYLAGIKAGH

SEQ ID NO: 4920 - protein, 518 aa, Bacillus licheniformis
MSLLTVTKLSHGFGDRAIFHDISFRLLKGEHVGLIGANGEGKSTFMNIITGKLEPDEGKVEWSKNVRVGYLDQHTSLERGQTIRDVLRNAFHYLFAMEEEVNAIYTKMGEADPDELEKLLEEVGTIQDALTNNDFYAIDAKVEEIARGLGLNDLGLDRDVAELSGGQRTKVLLAKLLLEKPDILLLDEPTNYLDEQHIEWLKRYLQEYENAFILISHDIPFLNSVINLIYHVENQELTRYVGDYNQFREVYEVKKQQLEAAYKKQQQEISELKDFVARNKARVSTRNMAMSRQKKLDKMDMIELPSEKPKPEFHFKQARTSGKLIFETKELVIGYDEPLSRPLNLRMERGQKIALYGANGIGKTTLLKSLLGEISPLSGEVERGEHLHIGYFEQEVKETNNNTCIEEVWNDFPSFTQYEIRAALAKCGLTTKHIESRVSVLSGGEKAKVRLCKLINSETNLLVLDEPTNHLDVEAKEELKRALKEYKGSVLLISHEPEFYMDIATETWNCESWTTKVL

SEQ ID NO: 4921 - protein, 376 aa, Bacillus licheniformis
MTERWPFLNKAKPFIQENWKASGFQDPTNVQKNAVDLILDGRDVIAESPTGTGKTLAYVLPILEKLEADQKNVQAVILAPSRELVMQIFDVIVEWKKGSDIRAASLIGGANIKKQQEKLKKHPHIIAGTPGRVFELIKMKKLKMHEVKTIVLDETDHLLTPEHRGTIQSIIKSTLRDRQLLCFSATLKDDAERELREMTKDAEVLKIKRSKEESAKVKHQFLVCDQRDKVKILQKFSRLPGMQALVFVKDIGNLNVYAEKLKFHHVEIGVLHSEAKKIERAKILQAFEAGEFTLLLATDIAARGIDIEDLPYVIHADLPNVEGYIHRSGRTGRAGNEGTVISLVNRIEEERLKKLAKKLEIPLQRIVYERGRIIER

SEQ ID NO: 4922 - protein, 340 aa, Bacillus licheniformis
MPQKQIELARRPQGIPVMDDFRIKETEIPEAKNGEALVKTLYVSVDPYMRGRMQDTKSYVEPFPLDEVITGGVIGEVISAKGDKLKKGDIVLGRLGWQEYSAVREDNLQKIDPSLAPVTAFLGILGMTGLTAYFGLLDIGQPKAGETVVVSGAAGAVGSAVGQIAKIKGARVVGIAGSDEKTAYLKEKLGFDEAINYKTTENMASALEQACPDGVDVYFDNVGGAISDAVFTLINKFARIPVCGAISSYNVKSAEEDMGPRVQTALIKSSALMKGFVVNDYRDRFPEGIKQLAEWVKSGQLQYEETITEGFERIPEAFLGLFEGKNLGKQLIKVADSDNA

SEQ ID NO: 4923 - protein, 127 aa, Bacillus licheniformis
MYYFSPEQQYNAWIISDLVKQIFSREGHQEADTHRFESFAARRFGINIDYVFSIIMNIGDPEERRTASSTEDLLSSYLLSLLSFITKDMFQYSRENANQYLLNERNADVFHLFLPDSVLKKTFRAIR

SEQ ID NO: 4924 - protein, 115 aa, Bacillus licheniformis
MKPVVRQYTNDEKLMKDVEELREIGVAREDIYVLSHDDDRTERLADNADANTIGAEETGIKNAVGNIFNKKGDELRNKIHEIGFSKQEAEQFEKQLDEGKVLLFVTDHEKVKSWV

SEQ ID NO: 4925 - protein, 138 aa, Bacillus licheniformis
MAKEKDAEQKSALNIIPLAVTILVGAVIWFIPSPAGLDPKAWHLFAIFVATIIGFISKPLPMGAIAVFALAITALTGTLSIEETLSGFGNKTIWLIVIAFFISRGFIKTGLGARIAYLFVRMFGKKHSDSRIHSLSAI

SEQ ID NO: 4926 - protein, 293 aa, Bacillus licheniformis
MGFQGNLITSAMFLTAMAANPLIAKLAHDVAGVNLTWTSWAVAAIVPGLVSLIITPLVIYKLYPPEVKKTPDAAKIATEKLKEMGPFKKSELSMVAVFLLVLFLWIFGGNLNIDATTTALIGLAVLLLTQVLTWDDIKKEQGAWDTLTWFAALVMLASFLNELGMVGWFSDAMKSYVSGFSWISAFLILIAVYYYSHYFFASATAHISAMYSAFLAVIIAAGAPPLLAALSLAFFSNLFASTTHYGAGAAPVFFGAGYIPQSKWWSIGFILSIVHIVTWLVVGGLWWKLLGIW

SEQ ID NO: 4927 - protein, 192 aa, Bacillus licheniformis
MFWSVDFMLLGFLYAIVYFLYDIVKNRKKTSFFRKIVFASFIVYLSAVYHYTIGGINIPPQPAYAQMNIQLIPFYFVTEWVQMYQQSGFDWFFWNSVKLTFFNVLLLIPLGVYLSVLWRKTSLKKAAVFVFLTSFLIESLQLVLSVTGLIMARTFNVDDLILNTAGGVIGFCLTSFMFGAKGSDSRRKGLHF

SEQ ID NO: 4928 - protein, 260 aa, Bacillus licheniformis
MADSQWFTVTELDESTYAISEYGHWEKVHSYLLIGAKDAVLIDTGLGIGSMKTVTDGLTDLPVSVITTHVHWDHIGSHDEYQRIYVHEAEREWLTDGIKGLPIEQIRRDVSRDITKPVPAGFSAETYTPFRGEPSGTLQDGDTVGCDSRPLVIYHTPGHSPGHICIFDPASGYLFTGDLLYTGAPIYAFYPTTDPAQLVQSLEKVSAIGRVKKVFGGHHQLGLAPDILEEAGHAARHLKKHGLAQHGTGMHRFKSLSFQF

SEQ ID NO: 4929 - protein, 265 aa, Bacillus licheniformis
MMSDPYMPLTSVNSGVLEEYAEGVFGLTVQIVNVYFIFDPDSREAVLIDAGMPKSAPFILREAKERFGDFRLKGIVLTHGHFDHVGALESLLETWPVPVYAHEKEMPYLMGKADYPPAKPQVKSGLVAKMSPLFPRHSINISSHVKQLNKDGSLPFLEGWKWIETPGHTPGHVSLFRQSDRTLIAGDAVTTVEQESLFEVAIQKQELNGPPAYFTMDWTKAADSVRKLAGLKPAALLTGHGVPMKGSDFSEALLDLSDRLPASDS

SEQ ID NO: 4930 - protein, 547 aa, Bacillus licheniformis
MKIQKRVQALLATSAMFAGLMLSDAVYAAETPYYGKNYTQPEQVSSLYPEPEETFSTPAFVKEGEAFTTQEEMMKFITSLTKKSPNVKIGNIGFSIEKRNIPVLYFTKDKQIRSISKKPTVWLQGQIHGNEPAAGESALAIAEKLAGPYGDKVLDKINVIVVPRVNPDGSYQFNRRLANGIDGNRDHVKLESPEVRAIHQEFNKYSPEVVIDAHEYGVGQNEFQSIGEKGSLKYHDILILSGKNLNIPKSIRHASDSLYVNGVRAKLDEKGFSNDAYYTTGKSKDGKIEIYEGGTEARIGRNAFALQPALSFLVESRGIDIGRENFARRVAAQVATHETIIDTTVKHAAEIKRLVSKEKLKLIQNGAKVSDKDQVVINSEFAGPFKDTLKVADIASGQAVDVPVQYYSASEAVPVLSRTRPTAYLVLPGHQDIEQKLKDQGLKSVTLAFKQKLTAEAYEVLSKETAGESEGRPVIKVETKLKKQKKEFPKGTKIYFTAQQQSNLLSIALEPESVDSYVSTGYIPSQKGKELPVYRFMLNTKTLNFKE

SEQ ID NO: 4931 - protein, 365 aa, Bacillus licheniformis
MESHEELWREAKAFIELCYGELSKSEEETRMRLHKIDKEIRETGSYTHTLEEIEHGARMAWRNSSRCIGRLFWHSLTVIDQRGVQTEAEVRDALFHHIQLATNGGKIRPFITVFPPEQNGQKKVSIWNHQLIRYAGYETEQGVIGDPASLELTKACEALGWKGEGTPFDVLPLVFQIDGRPPVWYELPREIVKEVRIEHPEIEGFKSLGLKWYAVPIIADMKLEVGGIHYNAAPFNGWYMGTEIGARNLADADRYNALEKVAAIMGLDTERNTSLWKDKALVELNTAVLHSYKKAGVSIVDHHTAASQFKRFEEQEAEAGRELAASWTWLIPPLSPAATHIFHSYYENKTLKPNYFYQEKPYLNK

SEQ ID NO: 4932 - protein, 212 aa, Bacillus licheniformis
MRKHIFSLAIIAMNLIMWAIAYPHISGQVPIHWSSSGEIDRYASKMEAMLAMIGLLVFVYVLMFLTPKIDPRRKNYQLFSKTYYILINAMLLIFSLINVLVIMTGLGYDLPAGSIVPVLVGALLIVIGNYLPRVRSNFFFGIKNPWTLSSDSIWKKTHRFAAKVFTLAGLLIAADGLLSISPEIMLPVILATVLAPYIYSYVLYRKEINMKS

SEQ ID NO: 4933 - protein, 97 aa, Bacillus licheniformis
MLNMNQTFKALADPTRRKILNLLKDRDMTAGEISDQFQMSKPSISQHLKILKQAELIQDEKKGQYIIYSLNTTMFQEIIGWAFSFTEQAGKDKGDAK

SEQ ID NO: 4934 - protein, 90 aa, Bacillus licheniformis
MLQYRIIVDGRVQGVGFRYFVQMEADKHKLTGWVRNRDDGTVEIRAEGLEESLKQFLKAIQKGSPFSKVTDVKVEETKELDGFQKFNISY

SEQ ID NO: 4935 - protein, 216 aa, Bacillus licheniformis
MENQEYEIISIHVGRPRTYEFDGKQVETAIVKEPVSGPVYLSRTNFEGDGQADLIHHGGEDKAVCVYPADHYMYWESVLKRKLPEAAFGENVTVKGLTEKEVCIGDIFKLGEALVQVSQPRQPCFKLAKRLNQKDMVLKVRDTGYSGFYFRVLEEGIVAPDSRLQLVSRDAHEATVSYANHLMYHDMGNHPAIRKILEVEALSESWRSSFLKQLSA

SEQ ID NO: 4936 - protein, 70 aa, Bacillus licheniformis
MPPIPFQRFSIDVRIPIASKYRREFSAMHYGSKGWYVEELKKLGMTKYEGRKLQSYKKHFLANLLESVKQ

SEQ ID NO: 4937 - protein, 51 aa, Bacillus licheniformis
MLFAIIGLIFFIESILLIVYAHKKKNGFLKYIGIVLSIAIIVMIVTSLTHG

SEQ ID NO: 4938 - protein, 250 aa, Bacillus licheniformis
MIVTNDQELEGLKKIGRIVALAREEMKAKAAPGMSTKELDLIGKEVLEAHGAASAPEKEYDFPGTTCISVNDEVAHGIPSESRILKEGDLINIDISAEFGGYYSDTGISFVLGKGDEMLHKLCQSAESAFQKGLLQARAGKKQNQIGRAVYNEAKANGFTVIKNLTGHGIGRNLHEAPNHILNYYDPFDNALFKNGTVIALEPFVSTKAEHTIEAGDGWTFKTPDGSFVAQIEHTIVITKNEPIILTQLD

SEQ ID NO: 4939 - protein, 575 aa, Bacillus licheniformis
MSFLLYANVVYYRFFSDFITLPAIMQAKTNGGQLGDSIFSLMHPLDVLYFIDTFILIGLAVFYNRPSETTTKRPFKIVMGASILVFLANLAVAEIDRPELLTRSFDRNYLVKYLGTYNFTIYDAVQNIKSNSQRALASSSDVTEVENYIKANHDKPNAEYFGKAKGMNVVYISLESLQTFLIDYKLDGKEVTPFLNSLAHDNETFYFDNFFHQTGQGKTSDAEFMMDNSLYPLSQGSVFINKAQNTLQSAPAILKSQGYTSAAFHGNYKTFWNRNEMYKAIGYDKFFDATYYDMSEDKTKNYGLKDKPFFEESMPLLKSLKQPFYTKFITLSNHFPFEMDEGDTDFPAGDTGDSVVDHYFQSANYMDQALEQFFNDLKKAGLYDNTIVVMYGDHYGISENHNKAMAKVLGKDITPYENAQLQRVPLFIHAPGVKGIKSHKYGGEVDVAPTLLHLMGVNTKDYLMSGSDLLSPEHREIIPFRNGDFVSPEYTKTNGNYYDTKTGELLNEKDIDPNIEEAVKKELEMSDKIVDGDLLRFYKPKGFKAINPSDYDYTNHNPKTSESDAAQTTKSDSGQ

SEQ ID NO: 4940 - protein, 128 aa, Bacillus licheniformis
MDFSSIVSEDKIKQAIKDGEFEGLPGMGKPLKKDDAAHVPEHLRMAYRVMKNAGMAGDEGALKKELMTIDDLIAKCADEDERERLIERKTETRLRLDRLADKKGMFSKPASAFYKEKVYRRLSGNKKR

SEQ ID NO: 4941 - protein, 466 aa, Bacillus licheniformis
MNWVEYISDWLWGPPLIILLTGTGVYLTILLKFFQFRYPLYIFKQTIGSVGKKPKGEGTVTPLQALTSALSSTVGAANIVGVPAAIMFGGPGAVFWMWLVALFAMAIKFSESVLAVHYREKNEEGEYVGGPMYYITKGLSMKWLGVFFSVALMIELVPSIMVQGNSVSASLAETFSFNRLYTGIGIAFLIGLVVIGGIKRIGKVTELAVPLMAGAYIGAGFLIVVTNLSSVPAFFSLIFSNAFTSSSAFGGFAGAAVAETVRWGFARGLYSNEAGMGTAPIAHAAAMTDHPVRQGFWAVIGIVVDTLLICTTTAFVVLASGVWTGENASSDPGALAAAAFRSYFGPVGGYFVSVSLVFFVLSTITVVIFYGVKQAEFLFGRLAGHVIKFIYLAAVVIGAAGGAKAIWGFLDLALVFILLPNILAVLLLSRKVRSLYDEFFTSEKYYLKDIGQQDGVYEGDEKVNNL

SEQ ID NO: 4942 - protein, 470 aa, Bacillus licheniformis
MTDLNQSARRIVDAVGGADNIAAVTHCVTRLRFALLDESKVNQEVLEQIDVVKGSFSTNGQFQVVIGQGTVNNVYAELVKATGIGESSKDDVKKASEKNMNPLQRAVKTLADIFIPILPAIVTAGLLMGINNILTAQDIFFSGKSIVEVYPQWADLANMINLIAGTAFAFLPALIGWSAVKRFGGNPLLGIVLGVMLVHPDLLNAWGYGAAEQSGEIPVWNLFGLEVQKVGYQGQVLPILLASYLLAKIERFLTKRTPESIQLLVVAPITLLVTGFASFIVLGPITFAIGNVLTSGLIAVFEQFAVLGGLLYGGLYAALVITGMHHTFLAVDLQLIGSKLGGTFLWPMLALSNIAQGSAALAMMFIVKDEKQKGLSLTSGISAYLGITEPALFGVNLRYRFPFVIAMISSGIAGMFISSQGVLASSVGVGGVPGIFSIMSQYWGAFAIGMAIVLIAPFAGTYLYAKLKMK

SEQ ID NO: 4943 - protein, 562 aa, Bacillus licheniformis
METKENPWWKKAVVYQIYPKSFKDTTGNGVGDIRGIIEKLDYIKELACDVIWLTPIYQSPQNDNGYDISDYYSIHEEYGTMADFEELLEEAHKRGIKVIMDLVVNHTSTEHRWFKEAASGKENLYRDFYIWKDMKPNGAPPTNWESKFGGSAWEFHAESGQYYLHLYDVTQADLNWENEAVRKKVYEMMHFWFEKGIDGFRLDVINVISKDQRFPDDDEGDGRRFYTDGPRVHEFLNEMNREVFSKYDSMTVGEMSSTTIADCIRYTNPESRELDMVFNFHHLKADYPNGEKWALADFDFLKLKKILSEWQTEMNKGGGWNALFWCNHDQPRIVSRYGDDGKYRKKSAKMLATAIHMLQGTPYIYQGEELGMTNPKFDDISLYRDVESLNMYRILKEAGKPEAEIIEILKAKSRDNSRTPVQWNGEENAGFTAGTPWIPVPDNYKEINAEEALNDPDSIFYHYKKLNELRKEFDIITTGDYQLILEDDQELYAYLRNGADEKLLVINNFYGKETEFQLPDDIDIEGYDAKVLISNDTDLPESFKRFTVKPYQSIVYHLAKPC

SEQ ID NO: 4944 - protein, 238 aa, Bacillus licheniformis
MKINKYMMIYKQIAEQIDQSILNAGDILPSENDLAEQHDTSRETVRKALNVLAQNGYIQKIKGKGSVVLHREKMQFPVSGLVSFKELSETLGKETSTTVHEFGLTHPDAYIQKQLRTSGDEEVWRVVRSRNINGERIILDKDYFIRKHVPLLTKEICEDSIYQYLEDECGLVISYAHKEIVVEPCTAEDQEYLDLNGYEHIVVVKNFVFLDDTTLFQYTESRHRLDKFRFVDFARREK

SEQ ID NO: 4945 - protein, 230 aa, Bacillus licheniformis
MIHETAKIGKNVVLGEHAVIEENVVIGDNVTIGHHAIIKKDTHIGSGVKIGDLAVLGKAASSNKKMARQPKQAGAPLRIEDDAIVGASAVIYRDVLLEQGVFVGDMASIRENVAIGRESIIGRNAMVENNTRIGSKATIQTGCYITADMTIEDEVFIGPCCSTSNDKYMGKGNYPYQGPTIKRGAKIGNNATLLPAVVVGEGAVIGAGAVITKDVPAGKTAVGNPGRLMK

SEQ ID NO: 4946 - protein, 1094 aa, Bacillus licheniformis
MSIQNAVMNGGFETGAFSPWVGVNTSVTSQFSHSGFFSARFLGGTATSYIAQFVPAGAGEGSEFLVSLAKAGFLPAPSVTIQVTYFDSQFNFLGYGLFATVTSSRIPAAENGTWLEVYQTTSPAPLGTTQAFILINNIPQAGTASVFVDDVALLSVEGGGAPTGATGPTGATGPTGATGPTGVTGPTGVTGATGPTGVTGPTGAMGPTGATGATGPTGVTGSTGVTGATGATGPTGVTGPTGAMGPTGATGATGATGATGATGATGPTGVTGATGATGPTGVTGATGATGPTGATGATGPTGATGPTGATGATGPTGATGAMGPTGATGPTGATGPTGVTGSTGATGATGPTGATGAMGPTGATGPTGATGPTGVTGSTGATGATGPTGATGAMGPTGATGPTGATGPTGVTGPTGETGATGPTGATGPTGVTGATGPTGVTGPTGVTGPTGATGATGATGPTGVTGATGATGPTGVTGATGPTGETGATGPTGATGPTGATGATGPTGATGAMGPTGATGPTGATGPTGVTGPTGETGATGPTGTTGAMGPTGATGPTGATGPTGVTGSTGATGATGATGATGPTGATGPTGATGPTGVTGATGPTGVTGPTGATGATGPTGATGPTGVTGPTGATGATGATGPTGATGATGPTGATGPTGATGATGPTGATGAMGPTGATGPTGATGPTGVTGPTGETGATGPTGTTGAMGPTGATGPTGTTGAMGPTGATGPTGTTGAMGPTGATGPTGTTGAMGPTGATGPTGTTGAMGPTGATGPTGTTGAMGPTGATGPTGTTGAMGPTGATGPTGATGPTGVTGSTGATGATGATGPTGATGAMGPTGATGPTGATGPTGVTGATGPTGVTGPTGATGATGPTGATGATGATGPTGPTGVTGAAGATGPTGVTGATGVTGSTGATGATGATGATGPTGVTGAAGATGPTGAAGATGPASPQTAIFFNNLFGSTSVYNPPTIPLNTEVTVVNVPNVPVTSGQNIKVDYALAVEAVNTANSNIVFEIRLYRGGTLVQSRIFNRSLASAGTQRFPLASTIVDTVPATATIDYSVRVAVTTASNVTSAAAFNRDLNLIRFP

SEQ ID NO: 4947 - protein, 720 aa, Bacillus licheniformis
MSIQNSVVNGSFEAGSLSPWAGQNAAVTTQFSHSGFWSATLLGGATVSFIAQFVPVDEGEGLEFLVSLAKSGILPSPQVQIQVSYFDSMFNFLGQGLFINIPFNRLPVVQNNAWLEVYQTTSPAPSGSTMAFILINTLPQAGTANVIVDDVALLDIEVADVIGPTGPTGATGPTGATGPTGATGPTGATGATGPTGATGATGPTGATGATGPTGATGPTGATGATGPTGATGATGPTGATGPTGATGPTGATGATGATGATGPTGPTGATGATGPTGATGATGPTGATGATGPTGATGATGATGATGATGATGATGATGATGATGPTGPTGATGATGPTGATGPTGATGATGPTGPTGATGPTGATGATGPTGATGATGPTGATGATGATGPTGATGATGATGPTGATGPTGPTGATGATGPTGATGATGATGATGATGPTGATGATGATGPTGATGATGATGATGPTGATGPTGATGATGATGATGATGPTGATGATGPTGATGATGATGATGATGPTGATGATGATGATGPTGATGATGATGPTGATGATGATGATGPTGATGATGATGATGATGATGPTGATGATGPTGATGATGATGATGATGPTGATGATGAKQRERQEQQEPPARPEPPEQQERQEQRERQVRREQRERQVRREQREQQVQQERPEQREPPARPEPPEQQVQQERPEQREPPARQERPEPPEQRERQVRQEQQE

SEQ ID NO: 4948 - protein, 364 aa, Bacillus licheniformis
MIRLIEPYITFEEVQAELKEIFSSGMLTKGPYVRTFADHMRQYVSAKHAFLTTSATTALSMCLKSLNVQPGDEVIVSDFSFPATVNVIEDLGAKPVFADVDLETFNMLPEELESQITSRTKAVLFVDALGNPTGITNIKQICKEYGLPLVDDAACAIGSSEYGCKSGKIADLTCFSFHPRKLLTTGEGGAITTDREELKDWLSVKLNHGAAISDGKLDFIDFGYNYRLSDIQAALGIKQLQKLDDIIHRRNLQQKAYSEQLEPLGFQSQKIGPAVVHNIQSAVFKVPKNIVRDELIQYLSDCHIESTFGTYCLSGTPYYRRKYQQLKSNSLFLEQHTITLPCHDEVDLDHVVSAIQSFIKFKVD

SEQ ID NO: 4949 - protein, 180 aa, Bacillus licheniformis
MKQWKSEGKGEFTLSQLGGCGENVVIEDGVRIFHPENIYIGDNVYIGHDTILKGYYKHDLIIGSNSWIGQQCFIHGAGGVTIGEFAGIGPNVRIHAAYHTDPDKPDSTILFSPLTFAPIHIEENCNIGIGASILAGVTIGAHSKIGANAVVNRNIPPYSIAVGVPAKVIKNRRMKDEDLS

SEQ ID NO: 4950 - protein, 324 aa, Bacillus licheniformis
MSDMTELSGQHIFITGGAGFIGSSLIGKLIERNSVTVYDNFSRDSLRYKPYRDHPHLKVLQGDILDLNALKKAIQGASHIVHAAGIAGIDTVIQNPVKTMQVNMIGSANLLEAAAGLTECKRVVCFSTSEVFGQIAFRARETSHTVLGAVGEARWTYAVSKLAEEHMAYAYFKELGLPTVTVRPFNVYGPEQVGEGAIKTMVHRALLDEPIYIHGDGTQIRAWCYVDDMIDGILRCLTMKEAIGESFNIGNERTVITVYGLASTIIRVLGSKSQIFFGEKKEADIELRIPQVNKAKEMLGFSAKVDLEEGIRRTAESIKKNLDQ

SEQ ID NO: 4951 - protein, 457 aa, Bacillus licheniformis
MKDFKSDIIHCLEQKEWNKAMKRLKEWEAQGSHNEPDFYFLQASLSVYLGHDYNAWLWLWRGLDLFPENRSLNLLMGKVCLRTGREKESAAYLQKGDGAETASWPKLDLPVDEKTEPPAGQIRILQGTMEIANQMNTLAKGLSQHGALAHTLNYYPYYLNYAADYTWSLLKERNTPAMNAKLRRLANDLLPSYDLFHFHFGTSFTLDMSDYPILKQAEKPMVMHHWGSDVRLYSTLAKTNPYAVVKTKNEARIRYHLKRISQYVQHCIVADMELYEYVKDYYEHVHMIPTMIQLDRYTPDYRSNEKPLIVHAPTSPGIKGTRHILKAVESLKEKYDFHFHLVQGVSHEQAKKIYQKADLIIDQLHIGSYGLFAVESMAMGKPVICWISDFMKDHYPSELPLIRANPANITEVIENVLKNRDMLPEIGQKGRKYAEVHHDMVKNSKKTLAVYQSLLSE

SEQ ID NO: 4952 - protein, 661 aa, Bacillus licheniformis
MKEKEDLFKKMVRRPKIIFFVKPDLDRFLNSVVEHLSGTYRTKKIVVHDLNQIDAGMQWADICWFEWCDDLLIHGSKVPSAAAKTLICRLHSYEAFTFYIKKVYWQAVDQVIFDGEHLREYVLDQVKALKKEKTAVVPNGIKLDQYTFKQRQKGFHIAYVGYINYKKGPMLLLQAFKALIDKDPRYKLFIAGTFQDARYQLYFKQMIDELRLTDSVQFDGWQDDMNQYLEDKHYLICTSLLESQHMSAMEAMAKGIKPLIHNFYGAKTIYDESVVWNTIDEFVAMITSGDYTSLHYRSFIEEHYSYDLSMRKIEEMISGFAKQSELTVMPNPPLITVGIINYNYSNFIDECLQSVLNQLYPNIDILIVDDHSTDDSMQKISSYQKTHPHIRTICHSENTKLPDLAFKEIFQEAKGEYVLLLSADDFLPHNLVIHDFMQCFFEEEGLDYVYGDLLLVDQHGKNAGLWTYQEYGDEELVRTIFQRGGSGIVPMVGMFKASYYQQKGFTWLVDPQKPLAGDVLNCLANTKRGWKRRYLKKPVLCYRRHQKNISYQLHKRIQSLVYVMDYIVKEFDESVYFPHIKWKELEENQRQSLKYFSIGKTFWRMARRYAQNGYTRHLDQDAKKECIQPLLDKMDEYFQLSLASDNQYERYMKNIKKIQLI

SEQ ID NO: 4953 - protein, 360 aa, Bacillus licheniformis
MVTISLCMIVKNEEEVLARCLDTVKDIVDEINIVDTGSTDKTVEIAKRYTDRVFFFEWIGDFAAARNESFKHATKDYILYLDADDVLLEEDQKKLKELKETLDPSVDSVSMYYDAGTDEFGNVTLRYRRNRLVKREKNFKWKGDCHQYLEVFGNIINADISVTHKKIRHSVGRNLNIYQKKIDRGDTFTPRDYFYYGNELRENRHYEKAIESYNKNIEMKEGWIEDKVYACINKADCHRFLGDMDNELRSLFQSFEFSKTPRAETCSRIGYNFQRRREYKAAIYWYELATTLVPDSNKWSFTYPAYYTWYPHLQMCVCYYNLGDFEKSYHHNEEARKYRPEDKSVLHNKQLLEGKLGINN

SEQ ID NO: 4954 - protein, 369 aa, Bacillus licheniformis
MIPLVNLKRQFQTVKQDILKEFEHVLDSGQYILGPKVEELEKRIAEKLGVKEAVAVANGTDALVLTLEAFGIGKGDEVITTPFTFFATAEAVSRVGAEPVFADVDPETYNLDPKKIEEKITPATKAIIPVHIFGQPADMDEIMELAKKHGLLVIEDACQAFGASYKERPVGSIGDAACFSFFPTKNLGTLGDGGMVTISDPDAARQLRTLRTHGTSKKYFHDKIGFNSRLDELHAAALLILLEKIDGWNEQRRRVASRYREGLKTAEHLTLPAEKEDRTHIYHLYCIGAKNRDYIIQSLKEQDIHSGVYYPCCLHLQSVYSSLQYKKGDFPIAESLSETLFAIPMDPFLAAEEQDQIISALLKKGGGEK

SEQ ID NO: 4955 - protein, 354 aa, Bacillus licheniformis
MTVHFGLIGCGYMSRKHLQALAECDDAKLSAVSDLQEERMKEAEEYYASLAGEESRMTRYPQYQALLSDPKIEAVIIAAVSGLHAEMAKHALLAGKHVIVEKPMTLSLRDADELIELAEQNGLKLMVCHQMRHRPIMKKLKETIEEGKLGKIYLGTVSLRLNRSPAYYEAASWRGSWEKDGGMLVNQGIHLIDLLQWFLGDVKGVYGDMLGGSGAKETEDVAVGILTFASQAKGVVEANIVTQPNNIGSSLSIFGENGTISLEGPALNRISRWYIHGEKADAEEAAKLIDIGGEQTAMYQNFISALKRQDTLLVDGYEGKKAIETIFGIYQSVLQKQPVQLPLSSFQTTDMKNK

SEQ ID NO: 4956 - protein, 431 aa, Bacillus licheniformis
MSKQEIHNETIAVIGLGFVGLPLAMLLISKGMRVIGVDLDKKKVEALRKGTSYISDINDQAVQDGIGTGFFRPVSDYSLIGEADAVIICVPTPLNDDAGPDLNYVKRAAQLIGAHLKKGQLVVLESSTYPGTTRDIVKPILEKSGLVCGKDFYLAYSPERVDPGNQFPIEVVPKVVGGATDACLEKVHQLYSGIYEEVVPVTSPETAELTKLLENTYRFINISFINEFAMICDRLGVNVWEVIEAASTKPYGFAAFYPGPGIGGHCIPVDPLYLQFVMKQSGLSSDFIELSEATNDRIVRYISERSLQLAGKDKATDARILIYGVTYKRNIADVRESKSLDIIEKLIGMGADVSYHDPHVPDLDLSGKKLASVPIDSKMLKEYDCVVILTDHDALPKELLLNHANVIFDTRGVLREAAGKAKVIQLGNGRS

SEQ ID NO: 4957 - protein, 303 aa, Bacillus licheniformis
MWIGILLMVSGIGISIFAVSLIVSYLFVLPNRSTYEETFFSGLKHGEIIDDVFESHDKEELFLTAGDGCRLHALLFPVQKSRKAVIISHGIKWSLFGGYKYVELFQSIGYNVLLCDSRCHGLSGGSHVSYGFYEKDDLARWADELENRFGKDLWIGVLGESLGAAAAIELMKQDRRIKFCIADSCFSDLTELCRFQLKAAVKLSVPFLIPLASGLIKRRHGWSLADISPVSNLEQSDTPLLIIHGTKDQLVPPEMAKSLYERKKGFKKLYWIEGAGHVGGFRHNPEEYLNKIKDFILKIEPAN

SEQ ID NO: 4958 - protein, 130 aa, Bacillus licheniformis
MKKHPAACEAPDGYSCPVEATIDIIGGKWKSVILYHLIDDKKRFNELRRLIPGVTQRMLTLQLRELERDGIVCRTIYKQVPPKVEYSLTEFGKTLIPIIRQMMNWGTSYAGKIKEARQRSAAAEKLESQG

SEQ ID NO: 4959 - protein, 227 aa, Bacillus licheniformis
MTEQSKKQEILDAFQFRHATKEFDPDRKISDEDFQFILEAGRLSPSSVGLEPWQFVVVQNKELREKLRQVSWGAQGQLPTASHFVLLLGRTAKEMRRDSGYVADQLKHVKKMPEDIIENMLKEDGVLESFQDGDFHLYESDRAMFDWVSKQTYIALANMMTAAALIGIDSCPIEGFNYDKVHDILEKEGVLEDGRFDISVMAAFGYRVKEPRPKTRRALDQIVKWVE

SEQ ID NO: 4960 - protein, 1423 aa, Bacillus licheniformis
MILSLLMPNTQTYAEEQNEHPLISLSILGTTDIHAHMMDYDYYADKETAEFGLARTAQLIEKYRSRNPNTILVDNGDLIQGNPLGEYIFKHERESIISGTKTHPIIDVMNKLQYDAGTLGNHEFNYGLEFLDGTIKGAEFPIVNANIKTPDGKNKYTPYHIEDRTLTDESGRKHQLKVGYIGFVPPQILTWDKKHLDGKITVQDITESAKETIPKMKQEGADVIIAIAHSGIENGEQAAGAENAVYDLALKTEGIDAIISGHQHGLFPGTDYPGNGVIDNQKGTINGIPVVMPKNWGSHLGIIDMQLELDGGKWKVKDASAKTEAIAGNVTSRNETVVSAIKDTHEKTLEYVRAPVGQTEADINSFFAQVKDDPSIQIVTDAQKWYAEDVMKGTEYENLPILSAGAPFKAGGRNGADYYTNIKAGNLAIKNIGDLYLYDNTLYIVKLTGSEVKDWIEMSAGQFNQIDPSKSGEQALLNPDFRSYNFDVIDGVTYQIDVTQPAKYNASGGVKNPQANRVKQLSYNGKPVRDDQEFLVVTNNYRASGGGGFPHLTQDKVVYAAADENRQVLMNYIMEKKTVNPAADNNWSIAPIKGADVTFESSLLAKPFAEKANDIDFVRESENKGYGVYKLNFDGSEPPVDDENWTLTVMHTNDTHAHLDGAARRAAKVKEIRSETENNVLLDAGDVFSGDLYFTKWNGLADLKLMNMMGYDAMTFGNHEFDKGPKVLADFLSGNYTAVDPLNRHQLEKPDFPIVSSNVDVSKEPKLRSFQKEPAVLAAGKKKESGIYPYILLDVNGEQVGVFGLTTEDTSYTSSPGPNIAFHDAYQSAEKTVKELKEKEKVNKIIALTHLGYNRDLELAKKVKGIDLIIGGHTHTLVDHLKVVENEEPTIVAQVKDYGQFLGRVDVVFDENGVVQTDQSRFNLIAIDDKVDEDPPGKEVLDGFKEDIDELKKKKVGYADVPLDGKREHVRSKETNLGNFIADGMLKKAKQAGGADIAITNGGGIRSGIAKGEITLGDVLTVMPFGNTLYAADLTGAQIKEALEHGVSQVEEGGGAFPHVSGLSFTFTLSKPKGERILDVNLVNDKGDAVPLDLDKTYRVATNNFMGGGGDGYSVFKEAKNGVDLGFTDYDIFTEQLALYDSVSPNIENRITEVFLPDRQADGSWTLAEKPFETYAKNANQAIAYFPDTEKEHIMLNMTKAQTDLVKERTGDPSITLKNDRIAMQLPAVNLASEKTKISIKIAKDIKQAVTKVYDFNIQQNGKTVSTFKEPVGLLFQVDAPDKHLSVYYVDRKNNSFTKVTNGYTKGRTVAGYVDHFSEYTVMNDNDAGSPSLPTGSGDDDTPDGGSGGEPPASPGAGSGGDGSGGHDSGGADDGNEPSDGSNGGFLPDTASNAYHWLMLGLLLLISGSGLYLYQRKRRKLQI

SEQ ID NO: 4961 - protein, 171 aa, Bacillus licheniformis
MSKKIAVVLTDYFEDSEYTEPAKAFKDAGHQLTVIEKEKGKTLKGKQGEAQVETDASIDEVSPADFDALLIPGGFSPDILRADQRFVSFAKSFMDDKKPVFAICHGPQLLITAKALDGRGATGYTSIQVDLENAGVKFKDEEVVVCQNQLVTSRTPDDIPAFTRESLKLLG

SEQ ID NO: 4962 - protein, 71 aa, Bacillus licheniformis
MSDQKTAELNKMIEEISQKLNMLNIGVIKAEDFSNEKLEDLEYLHQMVMKKKSFSPSEMQAIAEELAALRK

SEQ ID NO: 4963 - protein, 452 aa, Bacillus licheniformis
MEFISHIVDTMNGFLWGPPLLILIVGTGIYLTFRLAFLQVRLLPYSLKLAFSRHQDKSSEGDISHFQALMTALAATVGTGNIVGVASAVIAGGPGAVFWMWLAAFFGMATKYAEAVLAVRFRVKDKNGEMSGGPMYYLEHGLKQKWLGVLFAIFGALAAFGIGNMVQSNSVSGVMSSTFSVPAWVTGIIVTTFTALVILGGIKSIGRVTSLFVPVMALFYVIAGLIILVTNFELVPGAVGLIFSDAFTGQAVAGGAIGTVIRWGVARGVFSNEAGLGSAPIAAAAAKTDMPARQALVSMTQVFIDTLIVCSITGISIVMGNMYLTEKTDALTSMTFAHFLGPAGSTIVAIGLLLFAYSTILGWSYYGEKCFTYLLNEKYAIVYRIIFVIAVFFGAVFKNDFVWALADMLNGLMAIPNLIGLLGLTGIVVYESKQILAKIKAEKEEKQNSVSV

SEQ ID NO: 4964 - protein, 157 aa, Bacillus licheniformis
MMIKVLFVCLGNICRSPMAEAVFNDMLKKSGLEDRIEADSAGTGSWHVGKPPHEGTRSLLSEKKISCEGLYARQITDKDPEAFDYIIAMDAENAGHVRSLAGYGSKAVIRRLLDYVEDCETADVPDPYYTGNFEEVYELVAKGCRELLKDIRKEHNL

SEQ ID NO: 4965 - protein, 116 aa, Bacillus licheniformis
MKNDRVFIRNILLGASVGAVMSLLHKPTREACGAKLTACKNKVRLYRANPGMLTECVKEKMDEAKKLTASISDDLSFLNQQIKELKETTPKVIGLIEETRDHFTAKSKGRTEPEKE

SEQ ID NO: 4966 - protein, 271 aa, Bacillus licheniformis
MSFLKELGWRFFLHEGPSKSAELAYFFLLSLFPFMIFLLTLIGYLPVKTGDVIGLIEQYAPEDTMSVIEETLNTGNRGLLSFGIIAALWSASNGLNAIVRAFNHAYEVEENRSFIMVRLTSLLLTAAMVFTILVALLLPVFGRAIGHFIANLDGTPEMFLTAWSALRWGISPLVLLIVFTALYFFAPNKRLSFKFVLPGAVAATAGWILVSVLFSYYVSEFANYSATYGSLGGIIVLMIWFYLSGMMIILGGEINALLHKRKIIPEENPRN

SEQ ID NO: 4967 - protein, 392 aa, Bacillus licheniformis
MTRFHFFILVLIVSISGFSQGMLLPVISVIFEQEGHSAALNGLHATGLYIGVLIASPFMEAPLRRLGFKPLIVIGGVMVCASLFAFVFIQSFIVWFFLRLLIGIGDHMLHFSTQTWVTTLSSEKKRGRNISLYGLSFGLGFAAGPFLTPLVNIAPSLPFIVSGAFSLLAWLFIFCLQNDFPEKSGSESRSDNSLKRFAQAFLLGWVAFLPTFGYGFLETALNGNFPVYALRSGISVEGVSIILPAFAIGSIVFQYPLGVLSDKYGRRNVLLVILAVGAGCFFAAGFSESVLLLAACFFIAGMAVGSTFSLGISFMADLLPKRLLPAGNLMCGITFSFGSIFGPVAGGWYMQIFHNSNLFYLITCVMVLIWIGVLFGKTKKNGALEQSEAAPM

SEQ ID NO: 4968 - protein, 126 aa, Bacillus licheniformis
MEIVWNQNGFEADLEYGKLKISSNEEAGFRPYQLLAASIAACSGTVLRKILEKKRIQLKDMIIETKEERISEEAGRIKSIHLHFILKGENLGAEQIKKALRIALKNCAMVRSVENSIDIIETFEIR

SEQ ID NO: 4969 - protein, 351 aa, Bacillus licheniformis
MSRFFFWMMAAGVPLSVAGSLLHWPQVLLFIIYCLTIIALASYMGRATESLAIIAGPRIGGLLNATFGNAVELIISIFALREGLIGIVLASLTGSVLGNLLLVAGLSFFIGGLKYKRQEFNVYDARHNSGLLMFAVIVAFVIPEVFSAEMTEPRKLSMSVGISIIMILLYLAALYFKLVSHRGVYQTNQNEQEESHEEPEWSGKRATLILFLATVAVAYISEHLVHTFDTVAEQFGWSELFIGVIIVAIVGNAAEHASAVIMAYKDKMDVAVEIAIGSTLQIAMFVAPVLVISSLFFPTSMPLVFTLPELVAMASAVLLMIIISNDGDTNWFEGATLLAAYIIMGIGFFLL

SEQ ID NO: 4970 - protein, 263 aa, Bacillus licheniformis
MKKLLCFTLTAFLSFSFFAVQEADAAKPIKIPSSVTNISKENTYPNASQDQPRLQPSELAEELLKTTDIAIENPHLIKMLNESSISGTPLAIGYRATIYLGRWALGYTSNETVANWEYRKINTNRFDNRGGKAPAELTYSQEQTSKIKGGLTAKVPKAEDVKNMMMLKAMEKTKLPLAFETVVGSGTKRDQIYKVQPKKLGNLHAYAPAVNEKGKVTYGEVYIVLKGNKRKLVVKNITSQGIGAWIPVQDHLTFGFQLSHQPK

SEQ ID NO: 4971 - protein, 373 aa, Bacillus licheniformis
MTEKMQARPITPEYDPWEAYMDVDQFGDIQLTNVEFTTTTLCNMRCEHCAVGYTLQTKDPDALPVSLLLKRLDEIPRLRSLSITGGEPMLSLKSVKEYVVPLLKYAHERGVRTQINSNLTLDIGRYELIIPYLDVLHISHNWGTVEDFAEIGFAMMDKKPTFAQRARYFEKMIENSRTLVDEGVMVSAETMLNKRTLPHIEHIHRQIVEDMKCQRHEVHPMYPSDFASALESLSLKDMRKAIHRLLDIRDENTWMLFGTLPFYACSPDPEDHALLQRLREAKNVTVRNDPDGRSRLNVNIFDGNIIVTDFGDTPPLGNIQTDSLPSAYAKWRKTELAKELNCHCPHVRCLGPNVLVKNSYYQDVDFTSRTARV

SEQ ID NO: 4972 - protein, 61 aa, Bacillus licheniformis
MGNAVHDKEQQVNYLKNRLDMFMSVIDSLDPESTDLEDIDRLISMLDDLEAKYERFKKDWK

SEQ ID NO: 4973 - protein, 260 aa, Bacillus licheniformis
MKRICAICCGFLLTLAFSGNAEAISNKAIHWGFSKSKNHQPADAGQELTNLLQQYDAFYLGNTKEKTIYLTFDNGYENGYTPQVLDVLKKQNVKAAFFVTGHFVKDQPELIKRMAEEGHIIGNHSYHHPDLTTKTSRVIQEELESVDEEVYKITGEKNNLYLRPPRGIFSERVLEETKKLGYQTVFWSVAFVDWKINAQKGWRYAYDNMMKQAHPGAIYLLHTVSRDNAEALDQAITDLKKEGYTFKSLDDLMFEKSIDA

SEQ ID NO: 4974 - protein, 367 aa, Bacillus licheniformis
MSKSVKSVTSPKKFITGKRLLENLNDYIEDFGDNAYIICDEFILERAQKEAGNSIQKAGNQAVFEKFNYECTQEEIDRNRELARNAGANIIVGIGGGKTLDTAKATAYYEKLPVVIFPTIASTDAPCTALAVIYKHDGSFDRYLFLPTNPDVVLADSEILASAPPRFFAAGIGDALATYFEARACFKANGDNLVLMKPSTTGLGLARLCYDTLLENGVKAMQAVKHGVSTRAVEDTIEATIYLSGVGAESGGLAAAHAIHNGMTAVPSLHRAQHGEKVTFGLLAQLVLENAPAEELETVIDFIKGVGLPLTLKDLGVDEFVEEEWRQVAQSACAEGDTMGNMPFPVTPDDVYNAIVAANAIAESYHD

SEQ ID NO: 4975 - protein, 198 aa, Bacillus licheniformis
MKVHTGLAGIIMIVIGLLISAENHQGASVADALSGFLKLPIRNLVVLICMFMIIAGFIMAWRHYYGVPWIRFKLFLFIIGISVFYPLVTEQLMFFQKWNAQGDSAVEYMKRGSACSYQGDMEAGSMDCEVKVNNYGKKTARVQLTPDIINEFDFQPEELELSPHSQETYSVTFTAPGNEDAFASGIEEEPRLKIKVVK

SEQ ID NO: 4976 - protein, 319 aa, Bacillus licheniformis
MIKHFAMTKDGRLLSDNKAERLTDQDIEWFWTDFDQPSEEEVSLLKSHFHFHPLSVEDCVHRLQRPKLDQYEDYLFFVIHALNQKTLASEEVDLFVGKDFIVTFHFHHSDGIEKVRRQLSENSELWKNGPGHIAYMVMDTLVDEYFPILYKIEDRLNEIAESDSRKTYGTLMNEVFDIRGDLLKLRKTIIPMRDLLYRILNIEISKENRERKAYYSDIYDHLLKLAEIVENNRDMTADLRDSYQTLNSNRMNAIMMTLTIVSTIFIPLTFIAGVYGMNFDNMPELHWRYGYFFILGIMAAVVAGMIFWFRHKGWFDIFK

SEQ ID NO: 4977 - protein, 287 aa, Bacillus licheniformis
MWKETVSVTPPYHFDRVLDRLSLDPLNAVNLDKREVKLPLRNQNKEPRVVAVQATGTAEAPAFAVSGIDDRDDMIKEVKRIFRWEESLQPVLDHFSQSSLSSIFEEHAGTPLVLDFHLYHCLMKCIIHQQLNLSFAYTLTERFVHTFGEQKDGVWFYPLPETIAQLDYNDLRELQFSMRKAEYVIDTSRMIADGRLDLDELDQLSDEDIMEKLVKIRGIGPWTVQNVLLFGLGRPNLFPAADIGIQNAIKRHFGLNDKPTKEQMLEMSKEWHPYLSYASLYLWRSIE

SEQ ID NO: 4978 - protein, 463 aa, Bacillus licheniformis
MKRDKKGSSAELKVGQQFPLTIKRLGINGEGVGYFKKKVVFVPGALPGEEVVVEATKVHPKFSEGRVKKVRKRSEHRVKPPCIIYEQCGGCQLQHLAYEEQLKGKRDIVIQSLERHTRFDIGKMDIRPTIGMENPWHYRNKSQFQLGLSKNGKMVAGLYGLDSHRLVPITECIVQHPATNKTTQTVKQVLEDFGISVYNERKRTGDVRTIVTRVGFETGEVQVVLVTSKEDLPRKELIAEEIKKRLPEVTSVIQNVNKAKTSVVFGDDTRLLAGNMVIQEFLGEVSFELSARAFFQLNPIQTVKLYDEVKKAAKLTGREKVVDAYCGVGTIGMWIADGAKEIRGMDVIKESIDDANQNAKKHGIENARYVTGTAEHWLPKWTKEGFRPDVVIVDPPRTGCDRTFLDTIRQVKPKRFVYVSCNPSTLAKDLQYLAKDYHVEYIQPVDMFPQTAHVESVVSLKLK

SEQ ID NO: 4979 - protein, 159 aa, Bacillus licheniformis
MKRLCIIPCGAKKIWDVDPDIGPSAAKDVYLSPFHRACRAYAQTFFTDWVILSAKHGFLKPEDIVPENYDVTFGMRHPEIMPDGGLKAQGERKNLMDCDEIVMLGGKKYRPVLRNVFGSGQQIIYPLAGYRGIGYMLQALKRAVDEGRELGEHEKNEFF

SEQ ID NO: 4980 - protein, 187 aa, Bacillus licheniformis
MKDKERSIFEDLLPLYHEGLLSKETAEWIEEAAENDEELQKLLKMSEDELPKEHIESSVHEGQMFKRINRKLSLYQLMFMAISFFLAIRTSLLNESFGFILWYAVLGFAGYLFFRDMKLVMLLTYAPIFVWGMGDILAEWDASGGTGVVEHLLYAVFGAFVLAVIHCFFAAVGMMIGWLFLKLKERS

SEQ ID NO: 4981 - protein, 240 aa, Bacillus licheniformis
MKKKVLYSVLIVLLVSFVLAAYNAFNGNPVSKKLSQTALEHYLTDRYPEKDLRIDSGIYNFKFTEYVFEVTDTGDPKRKDPYLLTLRGFVQPEVYTDGIYEENLNEPLMERLGEEAGKEIKALLSKSIDQLKDVDVHVEVLKGKLKNDAKWEKSIRLDKPMQIHILLDAENAGRKEVYNTAQKIQRLLNEEGYDYESVTINANIFDGEDIKDEEIGCLKYSTSFEKNTEIKLKDVEELND

SEQ ID NO: 4982 - protein, 191 aa, Bacillus licheniformis
MQETNERIISAALDLMQKYGFKSVTIKDIALHSGVSEMTVYRHFKTKLGLLEAAVQQFSYIPAFQRVFENDITWNLEKDLTLIAESYLLHMEKNKPLYLIAVQDGGRMTDLFGSLLKHMEELLCYLTDYFRTMQDKNLMKKGDADSQAFAFLSSLYGYFSSGALAGGRFQKVAKDTYIKQITAAFCGGLHV

SEQ ID NO: 4983 - protein, 404 aa, Bacillus licheniformis
MKNILIVNFPAEGHVNPTLGITKAFADRGDNVHYLSTEKYKDRLEGVGATVHLYKDLVRNAHIDPNSPSGLLEFLKIHLKTSLYILDIVKELSKSISFDVVYYDTFGAGELVRDYLNIPGIASSASFLFGQEHKKILPLHPDSGAELHLDKECEDLLAELKEKYGVSPRHTGQFMSNQAELTVVYTSRYFQPDSGRFGDDVLFIGPRFPKRLDKTDFPVESLKNEKVIYISMGTVLGKTADFFNMCIDAFRDFDGKVVIAAGEKSDYAEIKEVPEHFIIAPYVPQLEVLKEADVFITHGGMNSVNEGIHYRVPMVVLPHDKDQPMIAQRLKELNAGYPLFAEEVNAERLRDAAEQVLTDGKYQEGIQKIDESFSNCMDIKDALARIDEYTARKKVAAAITESRY

SEQ ID NO: 4984 - protein, 106 aa, Bacillus licheniformis
MRKLCVCLLLVIPLSCTAVMPSAYGETRVYQELTDKQKNELASLQKDIMEKKKQLINKYVEYGILDQERGKEIKSHIEKRYEKEREDGFLPKWKHHKEKFRPHHIH

SEQ ID NO: 4985 - protein, 400 aa, Bacillus licheniformis
MKNRPVSERRLLGIAGLGWLFDAMDVGILSFIIAALHAEWKLTPQEMSWIGSVNSIGMAVGAFVFGLLADRVGRKYVFIITLLFFSIGSGLSALTTTLWAFLVLRFFVGMGLGGELPVASTLVSETVAPDRRGRVVVLLESFWAFGWLAAALISYFIIPAYGWQIALLITAIPAFYALYLRIALPDSPKYEKLAQERKPTIMENVKSVWSRKYARPTAMLWIVWFCVVFSYYGMFLWLPSVMVMKGFSMIKSFEYVLIMTLAQLPGYFSAAWLIEKAGRKMVLTVYLLGTAVSAYFFGSAESLALLLVSGMFLSFFNLGAWGALYAYTPEQYPTSIRGTGAGMAAGFGRIGGILGPLLVGYLVARGTEISMIFFIFCIAVVAAVAAIIFLGTETKQKELA

SEQ ID NO: 4986 - protein, 458 aa, Bacillus licheniformis
MQHKEIARELLPLIGGAENIISISHCTTRLRFNVRDEEKIDIAAIEKMESQQGTFFRYGLFQIIFATGVVNKIYKEMIQYSDPAPFEEARREARPNMNVLTRFAKTLSDIFVPIIPAIVASGLLMGLISVLKEFSLGAYGGPLMKMLDIFSSSAFVILPVLIGFSAAKQFGANPFLGAVIGGILTHPDLLDPSMLGSQKPESIEVFGLEVPLIGYQGTVIPILLSVYMMSKIEKFLKRIVPSSLDLIVAPFITVMASGFAALFIMGPLSLMIAHFISDCLGFVYHFAGACAGFLFGGLYALLVLSGLHHSFYVIEASLLADPEYGVNFLLPIWSMANVAQGGAGLAVFLKTKNDGIRKIAIPASLTAFLGIVEPVMFGVNLKLVRPFIGASIGGALGGAYAVFTHVAANSYGLSGIPMISIILPLGTANLIHYLIAFAIAVISAFIATLCLGFKDEKE

SEQ ID NO: 4987 - protein, 280 aa, Bacillus licheniformis
MKVKKILNNNALVVKDRGEEKIVLGSGIAFQKKKNDIVDRSKIEKIFVMKDSSEYRQFEEILKTLPEDHIQVAEDIISYAEKELGIKINERIHVAFSDHLSFAIERLSKGMVIKNPLLQEVKVLYTKEFQIGRWAKALIKEKLKIDIPEDEVANIALHIHTAKTNAGDMTKTLDLTTMIKDIIEIIENKLNIKIKDETISYERLVNHLRFAIQHIESGETFYEMDGEMISLIKKKFGQAFMCAEEIGAFVKREYGFEFPEKELCYITMHIQRFYQRSAVV

SEQ ID NO: 4988 - protein, 168 aa, Bacillus licheniformis
MEENKKILMIIGMEKQLEQTICRAANIQPEDALVLKSVFPDISQPYGDFMRDIITLVHRNKAEEIWIVRDKYEPSADEDISDLLNRDKDLKDRMQTLEYLFQNCSPEFTQGSIDEWLSPSENVAEGVQKSVAAIRRHPLIPLHVKVKGFLIDKSVLTEVEALNKNGAR

SEQ ID NO: 4989 - protein, 873 aa, Bacillus licheniformis
MKAAPTLSKQLIFQYEHQTADFNMDELVQSAARVIAPLWPIETFAARHPWMGLEEQTFEQTARQLKQQLHVDIYPKSSIFRSAKQRGEIDETILEKKLINWLDSHQPGMQRETAEAFCKAALKLDEIPGQLLRSRQVKKLAKQAARGTIDGRKTSFIKPLSVFAGQKSAHLLDHHVIKWCKLFLDESQSAWRLPHREKGFYSAWRQLVEHDPALSRAERQRLNGWPEEPRDAMKKALRAFDISNADVQAYLEAHLLSLPGWAGMMLWRSQQSQDEEELLLEYLAVRLSMEWMLVEPYLPLPKPNPEKEMQLVPLIASWLHWGGLTPEEWLELSAAEQKARLTLARRFDDITRRRLWLEAWEQTYAAEVRKLITANKPAAADKSETVLAQFAFCIDVRSEPFRRALEKSGPFETYGTAGFFNMAIETCELGTKHSHSSLPVILKPQHRVEETAEELPFKSYQEHKKAAASLSSAFKTMKQNLLAGMLLPEVSGPWLSLQMAARSLVPRAAGQAFRNARKTWLKKPQTKLSLDRTETSEAGIPVGFTEEEKAAYARQALKMMGITDRFAPLVVICGHGSRSTNNPYASALDCGACGGASGAFNARVLAALCNLPSVRERLRSDGIFIPDDTVFAAAEHITTLDELHWLYVPELPAKAQQAFDRINSVLPDVSRTVGAERLEELPQLGYQNPRNEVERFAEDWSEIRPEWGLARNASFIIGTRRLTRGADLEGRAFLHSYDWRNDEDGSILSGIISGPGTVAQWINLQYYASTVAPHYYGSGNKATQTVTAGLGVMQGNASDLLAGLPWQSVMRSDDEIYHAPLRLLIVIEAPDDDIERLLDRDHSFRQKAENGWIHLASINPEGKWKNWTNTINE

SEQ ID NO: 4990 - protein, 510 aa, Bacillus licheniformis
MFDMLDSLFWLKIFFASLALCLFSALLVLNRKVPLAYVRIHAKIIALPPLAALAALITANPGQAEASWRLDSLAWLIALFVLTIGFIVQRYSVRYLFGDRSYRKFFVLLTLTTGGASCAWLNDDLRWLLLCWGITLLGLTALIGLNSAWQAAKNAALYAGRIFALSWLAIAAAALWLSLSTGHWRLSSAIAEESLVQLSSWEKTGIGLLVILTVMIPAAQWPFHRWLLDSAIAPTPVSAVMHAGLVNVGGVMLTRFAPMFSGDVLQLILLVPAVLSVLLGTGMMIVQTDYKRQLAASTVAQMGFMLVQCALGAYIAAVIHLILHGLFKAALFLQAGSAVRRYESFASKPGRPALFWNMIGGVFALALVIGIWASATDDGYQLISALVLGWALFIAWRQLVTANYGRVTRIAGLFILTGASLAFAIIHSVLHGLLKDAVVQGAEPPAMAAVLTAVVLLAGSAAGALIVRQRFAWSGALYLRLVKTGEPHFESVEERPNYLDQYLTQGGRQS

SEQ ID NO: 4991 - protein, 124 aa, Bacillus licheniformis
MEKQKVTKGSLEAEISKALTQWEKDYLGRGSVSVKTDIIRNMVIVSLNGILTPAEYELCSTKEGLLSIKRTRSGLVESGIEQLSRMMKKLTGEETISFHTDISTRTGERIMVFKLANDLQKKLS

SEQ ID NO: 4992 - protein, 211 aa, Bacillus licheniformis
MSQFVYFVSCGNVVAAVRMNGRDEGGFFMKKAYVFLIDGFEEIEAIATIDVLRRAEVETVTVSLDPSRSVKGGHDIVVEADVMFDDADWQEADMLILPGGNVGSKKMLEHQALHKMLTEAANAGKYVAAICAATMTLGKTGLVSGKKATCYPGVEEHLTGADVTAHENVVVDGNIITSRGPATTIPFALKLAELLNGKEKAGAVAKGMLVC

SEQ ID NO: 4993 - protein, 324 aa, Bacillus licheniformis
MEEALTKEKAVWMYQKMLEIRYFEDQVHQLFAKGILPGFVHLYAGEEAVAAGVCAHLNDEDTITSTHRGHGHCIAKGCDLKGMMAEIYGKSAGLCKGKGGSMHIADFDKGMLGANGIVGGGFPLACGAALTAKYKKTKNVSVCFFGDGANNQGTFHEGINLAAIWKLPVIFVAENNGYGEATPFSYASSCESIADRAAAYGIPGVRVDGKDAAAVFQAAGRAIERAKNGEGPTLIECMTYRNYGHFEGDAQRYKTNEEKAVHQEEKDAIAVFKSELLAKGLMSEEEQSRIEKEVEEAVEEAVAFSEKSAYPEETELLTDVYVSY

SEQ ID NO: 4994 - protein, 344 aa, Bacillus licheniformis
MTREISMSAALNEAIKLAMRRDDHVILMGEDVAGGANVDHLQDDEAWGGVLGVTKGIVQEFGRERVLDTPISEAGYIGAAMAAASTGLRPIAELMFNDFIGTCLDQVLNQGAKFRYMFGGKAEVPITIRTTHGAGFRAAAQHSQSLYALFTSIPGLKVIVPSTPYDAKGLLLAAIEDQDPVIFFEDKTLYNMTGDVPEEYYTLPIGKADIKRKGADVTIVAIGKQVHTALQAAEQLSARGIEAEILDPRSLSPLDEEAVLASVEKTNRLVIVDEANPRCSIAADIASLAADKGFDSLDAPVKKVTAPHTPVPFSPPLEDLYLPTPEKVVNTVLEMLGETSTHTV

SEQ ID NO: 4995 - protein, 377 aa, Bacillus licheniformis
MAVEVVMPKLGMSMKEGTVSVWNKKVGEAVEKGESIASINSEKIEMEIESPANGTVLDIQVSEGEGVPPGTVICRIGNENEQTQESQTKQPDPTKERIKISPAARKIAQSANIDIKTLKGTGPGGRITKADVLQALPGRPNKQAAKAEAEERPPASPMRKTIAARMTESLQNSAQLTITMKADITKLTVLQKQLNETAQSRYDTKLTITDFAARAAVFSLLDHPAMNSVYQDGRLATFEHVHLGVAAALDEGLAVPVIRHAERLPLIELAKKIKWYAKKAREGRLLHDEIEGSTFTITNLGAYGVEHFTPILNPPETGILGVGQMYSAPVYQDGELTKGAILPLSLTFDHRALDGAPAAAFLSDVKNYLEDPASILL

SEQ ID NO: 4996 - protein, 458 aa, Bacillus licheniformis
MTLAIIGGGPAGYVAAITAAKNSREVILIEDGSLGGTCLNEGCIPTKALLESADMFEKIKSAGAFGIGLSGESPTVQWEAVQSRKREIIQRLAGGIEYLMNKNKIKVLQGKASFLSEHDILVEKDGKQEVINAGHVIIAAGAAPAALPFASFDGSWIIHSGDAMSLPSIPETIFIIGGGIIGCEFASIYSRLGANVIIAEQAEQILPEEDPDIAAFLRTSLEESGVRVFTSVQVERLDPARQRVFLKNGDDSFNIQADRCLVAVGRKPRTDDLKLDHIGVQYDRKGIHVNQHMQTNIPHIYACGDITGGVQLAHAAFHEGTVAASHASGRDMKVNSDIIPRCIYTSPEIASVGLNEKKARERYRDVRIGEFPFSSNGKALILNETAGKVKIIIEPEYQEIVGVSIVGPGATELIGQAAVMLHAELTADAMEHFIAAHPTLSETIHEALLQAAGRAIHC

SEQ ID NO: 4997 - protein, 611 aa, Bacillus licheniformis
MNPTPCYLNTWKRFVQEGLLDQARLNKRVMESWYRCKNRNVNPYLDKGQSILKKDLFDAQKKKHSLFLDIALPYLHNISRELKESEMMALLIDADGYVLSLAGCRRTLEEAKKINFVEGVRWTETEVGTNAIGTALEIGEAVTIHGTEHFSVASHHWSCSAAPIRDEDGTVMGLIDISCLTDRRHPFMLGMAATAAHAIEREISAHTKKNEAELISHCLEKIDSDQPFIVCNEKDKIVAASRPVRERFSDWRRMDVNDLYERGFAGGHKQTIFSAKDGRPLGKSIALAEVSRNKTAPSLVSRFIYPGETGTSRAFQQALHHMRLAAKTDANVYIWGETGSGKELAARAIHQASARRNGPFIAVNCGAIPESLMESELFGYAEGAFTGAKRRGSKGKFEQAHRGTIFLDEIGEIPYQMQVALLRIIEERKVTPIGGTREVPLDIRIITATHRDLKDLLQKGKIREDLYYRLHVYPVKIPPLRERKEDIPDLFRHYQQQHEWKAEFPPNFFKRLQEYHWPGNIRELFNTFERLRVLFPEGGLIDPSQYSAVLDGLDWNSGAPSEEDRLTFRERVQKQTMMEALQKTKGNVSEAAKLAGIPRSTFYKRLRKYNL

SEQ ID NO: 4998 - protein, 115 aa, Bacillus licheniformis
MNWSVLLMMIAIGLFLLAGLAEIAGGYLVWLWLRESKPLWYGLAGGLTLIIYGVIPAFQAFPSFGRVYAAYGGVFIILAVLWGWLVDKKTPDLYDWAGAVICLAGVSVMLWAPRG

SEQ ID NO: 4999 - protein, 449 aa, Bacillus licheniformis
MDKTYSIVIAGGGSTFTPGIVLMLLDNLDDFPIRQLKLYDNDGERQDKIAGACEVLVKERAPHIQFLATTDPEEAFSDVDFVMAHIRVGKYAMRELDEKIPLKYGVVGQETCGPGGIAYGMRSIGGVLELIDYMETYSPDAWMLNYSNPAAIVAEATRRLRPTSKVLNICDMPIGIEDRMAQILGLSSRKEMVVRYYGLNHFGWWTSICDKDGNDLMPAIKEHVRRFGYIPEQEHEKAEASWNDTFKKAREVFELDPETLPNTYLQYYFYPDDMVKKSNPEFTRANEVMEGREKFIFGECEKIAKAQSSAGSKIEIDDHASYIVDLARALAFNTGERMLLIVENNGAIQNFDSSAMVEVPCIVGKNGPEPITIGKIPQFQKGLMEQQVSVEKLVVEAWIEKSYQKLWQALILSRTVPNARTAKLILDDLIEANKGYWPELSAENLQPSL

SEQ ID NO: 5000 - protein, 256 aa, Bacillus licheniformis
MQLEELMNKHYKKLNENDFHVLKYILNHQDTCYKLGINELAKKCNVSRTSILRLSQKLDFSGYSEFRVFLKWEAEKREEEREDCRSFESLMRDMEASMKYLKNTDLRKMCQLIDEADRIFVYGSGTAQTTCAYELQRMFVSQHRYLTVIKDQIDFDLMFPDFSTADLIIIISLSGETPSLIPQAQSLSAKGIPFISLTNLKNNLLAQLTPYNLYAPSQTVTVYPKTELTAFAPFFLVGEALFRSYVDYAEEKKNQE

SEQ ID NO: 5001 - protein, 530 aa, Bacillus licheniformis
MMQKVQRFGSAMFVPVLLFAFAGIVVGLSTLFKNEQLMGSLASQDTFWYQFWYILEEGGWTVFRQMPLLFAVGIPIALAKKAQARACLEALTTYLTFNYFVSAILTVWGDFFGVDMTQEAGGTSGLAEIAGIKTLDTNIIGAILISSIVVYIHNRYFDKKLPDFLGIFQGSSFVVIISFAIMLPVALATAWIWPMVQDGIASLQSFLVASGAFGVWVYTFLERILIPTGLHHFIYTPFVFGPAVVEGGIVTYWAQHLSEFSASSEPLKELFPQGGFALHGNSKIFGILGIALAIYVTAKKEKKKIVAGLLIPITLTAVIAGITEPIEFTFLFISPLLFFVHSLLAATMATLMYAAGVVGNMGGGLIEILTLNWIPLFHQHGSTYVFQILIGLSFTAIYFFVFRFLILKLDIATPGREKDQQQETKFYSKKDYKAKKESEKEVSAAQEIAETDQAVLCIKALGGKENIAEVTNCATRLRVSVYDESKVEPDSTFKSFGVHGVVRNGKALQIIIGLSVPQVRERVEKLLNQS

SEQ ID NO: 5002 - protein, 192 aa, Bacillus licheniformis
MGTEMPAEFYDQFIDRHLIPFEKSPWRKVYEEAARLLPESKDETIVDIGCGTGRFAKLLYDKGYRKYLGIDFSKGMLEEAKRYNPSFTFIEGNVYDEAIVRMLQKYHVFVLLEVLEHIEKDKAFLSSLPQGSDMVISVPNYDSRAHVRHFKHIDEVIERYDGILDFQGTEKVVIKTSERLKNEIYVLNCKKR

SEQ ID NO: 5003 - protein, 325 aa, Bacillus licheniformis
MRRCLKILVLIKTFWKTMPKHEVKYKMMKSLEEFAEVMYWHTDGYLPDILDKIQFRPDFIFHYDIAYGFSLSPNIRGLKDTNIPTGAFVIDSHFNKQIRSSYFEDNQIDLIFSVTKEHFLNEYPQYKDKFRWVPWAVDPEIFKDWKLKKTIDYLLMGLVHEGNKRYPPKGKYLFREAVLQTMKHEEGFVHHPHPGNVITDEEEIKQAFLNEKYAQELNRAKIFFTCGSALRYPLLKFYEAPACRTLLLAEPNQDIFDLGFKDGTHFIACEVEDFYDKAKYYLQNKKERQRITDNGYRLVHSQHTYHARAQEIVDTIIDFLEQQEQ

SEQ ID NO: 5004 - protein, 112 aa, Bacillus licheniformis
MSLSSLCPKFEKGMKMISQRWNGFIIHQLLNGPQRFCHIESSLPISGRLLSERLKELEHEGIIHRHVYPETPVRIEYSLTEKGQALEPVLKGMEKWSQEWIDLDEANERENH

SEQ ID NO: 5005 - protein, 134 aa, Bacillus licheniformis
MVTGLTFLLHGLSKFQGGIENTVGFFSSVGIPGFLAYIVAIIELAGGALMILGLGTRVIGLLFAIVMLGAIFTVKLSAGFMGTDGGAGYEFDVTLLAMSVYLALSGSSMLSLGEMILKSRKEGKTDDAANPPGH

SEQ ID NO: 5006 - protein, 286 aa, Bacillus licheniformis
MTQQIHPGTELGYVKLKVSRLERSVSFYRDVIGFQVLKQDGKTAEFTVDGKNPLLIIEEIPNAVVLPERSAAGLYHFAILLPNRKQLGMAVKHLIRAGIELGQGDHLVSEAFYLSDPDQNGIEIYRDRPREGWKRDEQGNYVMGTEPVDVQGLLEEADGHEWQGLPPETKIGHVHFHVRDLKQAKEFYHSVLGFDITGDYQHMSALFVSAGGYHHHIGLNIWAGQHAPFAPLDAAGMAYYTVLLPNRAELDRIAKKLKSSGYAVEHEENAWFVKDPASGIDIRLTV

SEQ ID NO: 5007 - protein, 534 aa, Bacillus licheniformis
MAKSLTGKAKHHPPVWNPNIDGGRFCNPVLFMDYSDPDVIRKGSDFFMAASSFSCFPGIPILHSTDLVNWSLISHVFDELPFGEYEAPAHGKGAWAPSIRYHNGEFWVYFATPDEGIFMSKTSDPFKGWEPLIQVKKTKGWIDPCPFWDDDGNAYLIHAYANSRIGIKSKLNLCRMKKDGTALEDDGEIVFDGTLNHPTIEGPKLYKKDGYYYIFAPAGGVKTGWQTVLRSKQIYGPYEDKVVLHQGNTVINGPHQGGWVELDSGESWFIHFQDRGAFGRVVQLQPVRWFDGWPLMGEDINGDGIGEPVLHWEKPKTGAKEVKLPFDHGNDDFSSSDRLALHWQWEANPKQEWYSLSASPGRLRLYSRGIAHPFKLSRLPNLLMQKFSGPSFTATVKLSLNALSETMMAGLAVMGREYAYLGFSKSENGYRLSVYEGRIEGDQEDVKTEERGVHAEMVYLRVTVDEQAVCRFSCSMDRRHFTQIGNSFQAVPGLWTGAKAGVYCADTGGEDGQDGWCDIEWFSVEPAGGECHER

SEQ ID NO: 5008 - protein, 515 aa, Bacillus licheniformis
MSGEHTYTNPVLTGFHPDPSIIRVGEDYYMVNSTFQYFPAIVISHSKDLVHWKIIGHGITENEGLDLSDINDSHGIWAPDISYHNGTFYIFATHRLNGPTVINGRKLIRRQIMIKSSRPEGPYSKPVFIDEGSGIDPSHFVDGDGKHYMLLSPACTLFPLNEECTDISGEPVQIWEGTGRRAPEGPHLLKKDGYYYAILAEGGTGYSHSITTARSTHLYGPYEPCPYNPILTQTDPDAPIQRAGHGKLVETQNGEWWAVYLCGRPNQGSYTTVGRETALDPVEWTDDGWFVINNLKGPSLVQRAPNLPQVKWDEKNFDDFDEDTLGLDWQFVRNPDHSSWSLIERPGYLRLWTGDWDLHDIRAKNTVVRREKHHLYSAGVKLDFSPSASGEQAGIVCYYSTNNYLKCCLIYEEGLKIKVVENRSGCQKTLGKKHAEAGPLFLKAVINKQKRDFYYSYEGKHWHHAGGTEDASFLSDEGSRDAKGHTGTMVGIFANNGGSGRKAAADFDWFRYIAY

SEQ ID NO: 5009 - protein, 281 aa, Bacillus licheniformis
MLHPKYFIAEHSFSIQYMQRKGFTEMNAPHVHEGYELYYLLSGERTYFINQSVYTAEKGTMIIINPHDLHRTSSTEVQEFERILINFSHDFIEPLLKCSHYRLLPFPENQNFIAFSLREQAAVEHMLMEMKKECKLKKEGHEDVVRALLFQLLFTIYRSLAGGGRNQTRPLHPMDEKISEIASYINCSFQETMTLDGLAGQFYISPSYLSRVFKKVTGFHLQEYIRHIRIREAKKRLRDTDEKILDIAADTGFKHISHFNKVFKEIVGIPPLQYRKKSRDI

SEQ ID NO: 5010 - protein, 467 aa, Bacillus licheniformis
MKKLCCLILVLVFSAGCTQQKASTEEDGALEINWLVPLHTPQPPKEKALDIIEDKTNTKLKLIWVPDSTKEERINTTLASGNMPKVMTLPDLEDSAVVSALRSGMFWEIGPYFKDYPNLRKLDKTILKNISVDGKVYGIYRERPMARQGVVIRKDWLDNLGLEMPETVDDLYKIAKAFTEQDPDQNGKDDTFGLADRNDLTFGAFKTLASYFGAPNEWGTDEDGNLFPYFKHEAYKDAMAYMKKLYEEGLMNRDFAVTSKTQQQDLVIQGKAGIYIGAMSDAMNLRDQGLALNPGFQLDIANRIKGPDGKERTWALGGHGGMFAISKSSVKTEKEVRKILAFFDRIAEEDLNNLMLYGIEGVHYEKKGGSGYFRKQENYHLWEAEIQPLNQLIGVNKQALKSAEDPLRAKNEKLEEDNRAIAVQNPAEPLYSAAQMDRGTELKKIIDDATFQFILGEINEKALTRQS

SEQ ID NO: 5011 - protein, 197 aa, Bacillus licheniformis
MQTAVIYAHPNPNSFNGAILNQVIKALEDGKHFYDVIDLYRDRFDPVLLFDEKKRRSDMNRDPETAEYRRIVKNADHLIFIYPLWWGGMPAIMKGFIDRVFAAGEAYTYQGKLPKGLLKARTASVYYTADAPSWYLRFWQRDADWVTVKDVMLKFCGVRRVKRLLFAGVKDSSEEKRTQWLDRVYRSIAPADRGISK

SEQ ID NO: 5012 - protein, 203 aa, Bacillus licheniformis
MTKEMKWLDWAKEIQAIAQAGLAYTKDDFDRERFEQLRELSCEIIADYTETDFSKVKELFAGESGYQTPKVDVRAVIFKDHKLLLVQEKADGKWALPGGWADIGFTPKEIAVKETLEETGLKVKAHKLLAVMDKKRHNHPPSAFHIYKLFISCQIVGGKAEAGTETQNLGFFSLENLPELSAARNTYEQIEYLFEKHDEVYCD

SEQ ID NO: 5013 - protein, 125 aa, Bacillus licheniformis
MDQLKYPIGTFSKPLEADERELEKWIGDLKQAPHLLRSAAAELNEEQLDTPYRTGGWAVRQVVHHLADSHMNGYIRSKLALTEETPLIRTFDEQNWAGLTDARTLDPDLSLALLDTLHLRWAALF

SEQ ID NO: 5014 - protein, 850 aa, Bacillus licheniformis
MKKNALAILRIVIPAAVLLFVFFQAKKELAGLSFKETFLIIDQINRIDLFILVFLGLAAILAMTLYDFVLVRSLGMKVSKWKTIKVSWIANSLNNVLGFGGLSGAGLRTILYKEHVDDVKKLIRGIAWLASSVLLGLSVLSLLVLAGILPAGDLFTEKTWVLLAVAGTAMIAPGAAVILMIKKKRSRGAEKGMRLSVFFSYLGASVIEWVAAAAVMYYSLATMGVELDLKTVIGVFTIASVAGMISLVPGGFGSFDLLFLVGMSQLGVDQEITLTAIVLYRIAYSFIPFVFGLIFAAADLTGNTMKRLEEKPIIAPAIETTNILLILHRALLFRLLNGSLSVIAFCSGAIVIASVALPIDRITLIPNISKFMLVFFNGLSLSFGLILLILPLELYRRTKRSYYMTLTALALAFLFTLFKGFNISAVFMIPVVFALFVLLRGQFTRERAVYTFGQIAWGAFIFLFTLLNYNIIASHIWEALGHLLVKDYFIHSERHVDFATFFALFFVPLYFAVFIWAFNRKTKEIGEEPDPEKLEAFLEEKGGNALSHLGFLGDKRFFYSSDGNALIQFAKVGQRLVVLGDPSGREDSFPLVIKEFLHAADQKGYLVIFYQIEREDMALYHDFGYRFFKLGEEAIVDLDTFTISGKKRAGLRAIYNRFEREGYTFHVEQPPFSREFLNELRQVSDEWLGRKKEKGFSLGFFQEDYLQKAPIAVLKSEEGEIVAFMNIMPMYREGEISIDLMRYSKKAPKGIMDALFIYLFQWGKEQGYTAFNMGMAPLSNVGTTFQSFWTERLAAVIFNNVSYMYSFSGLRSFKEKYKPVWRGKYLAYRKNRSLPVTMILVTRLIGRRTK

SEQ ID NO: 5015 - protein, 119 aa, Bacillus licheniformis
MKPIEVLRYDAFSKTAGQGNPAGIVLEADGLTDWEMQKIAEQAGYNETAFLLPSESADIRIRYFTPGHEMNLCGHATVASLYALLEKGAIEAGADVKVETKAGVLSGGIPPQTAIGVFW

SEQ ID NO: 5016 - protein, 192 aa, Bacillus licheniformis
MNDTLEIQSIRDCVRNRRTIRKFKQDPVPKEVVLELLEDAIYAPNHKLTEPWRFIYIGTENGKKKHADNLKAAFKELKPNMQEEQINKFREHILSVPAFLFVIMKEDENERVRRDDFAAVSCLIQNLQLLAWEKGIGMVWKSGEVLSHETLHRLMGLKRDEQVAALLQIGYPAEIPEAKHRTPAAQLFTELT

SEQ ID NO: 5017 - protein, 64 aa, Bacillus licheniformis
MGRNAIHKNRDKNKQKLPQVPDQYKREADGVYEEYSAELADQDDREAQARMQAADKRAKKRQSK

SEQ ID NO: 5018 - protein, 37 aa, Bacillus licheniformis
MADKKKRERFKSTLNKTQEVRYSREFKMAERAAREKS

SEQ ID NO: 5019 - protein, 176 aa, Bacillus licheniformis
MLKKRELTDCYALFELMIHPDVFPFVRNKAETIEEYMFHVKNMIEEEEQGKLISRTILDEWENPIGCISLYEIEEQKGFLGTWLGKPYHGKGYNQRAKDAFFCELFYEKQIEAVFMKIRKTNMRSLKAAEKLPYAVKTDLDWAGSDTFHLYEIPKDLYTLYSMRTFEEENSRLKEA

SEQ ID NO: 5020 - protein, 299 aa, Bacillus licheniformis
MKIAIAGGTGFIGRHLTNALTARGHHVYILTRKPAETEQKNTSFVLWQKNGARPEKDLTDIDVWINLAGKSLFGRWNEKTKAEIATSRLRSVEESARIIQSLQKKPNTLIQASAVGIYGTSLEQTFTEESPVSAEDFLSRTTALWEQAAEPIEALGIRTVWMRFGLVLGKDGGALPKMALPYQLFAGGRIGSGRQWVPWIHIEDAVGMILSAIEQTLMSGPVNVTAPNPVQMDTFGQTVAKVEKRPHWLPVPEFAIKGVLGEMSMLVLKGQRVLPKKALQNGYHFLYPDLEDALHNLLA

SEQ ID NO: 5021 - protein, 263 aa, Bacillus licheniformis
MPYITKISAQKNNEERVNIFLDEKYAFSVDLDVLVKFDLRKGKELDELDIIEIQYGDDVKKGFKKALDYLSYRMRSTKEVQDHLKKKGVADSAITEILHMLKGYKYLDDREFAAAYVSTHRKTSGKGPDVLFRELKLKGIDDELIHEALSSFSFSDQVEAAVKHAEKVLKKEKKLSSKETKQAIEQHLVRKGFSFDVISAALQETDYENDDGAEREALEKQGEKAMKRYGYDGSYETKMKVKQYLFRKGFSIDLIDQFLDEKG

SEQ ID NO: 5022 - protein, 104 aa, Bacillus licheniformis
MEKRYSEMTAHELHQEIAGLTEKARKAEQMGIVNELAVHERKIAMAKAYLLDPADFKAGNVYEIEDGGDDFHIRYLNGVFAWGYRLSSPDHEEALPISLLKEKG

SEQ ID NO: 5023 - protein, 49 aa, Bacillus licheniformis
MRNKSRGFPNMNNNKFEGEPRAKDDFASKRPDGSTNTHPQERMRASGKR

SEQ ID NO: 5024 - protein, 89 aa, Bacillus licheniformis
MEEYFEKLTNALLEKNHMLSYAQARTWVELLWGDFEATFAKAGHPYRGKELTERVVKEWIEHYGSQLHLFQNDKPSYQDLFSGARGLLH

SEQ ID NO: 5025 - protein, 319 aa, Bacillus licheniformis
MKKGFVSIIIPSYNEASNIKLIYESLRNEFQSIDYDYEIYYINDGSTDRTLEEIKKLAEKSEHVKYISFSRNFGKEAAILAGFQHARGDAVVVMDADLQHPTYLLHDFIKGYEEGYDQVVAQRNRKGDNPVRSYLSSLYYRFINNAVEVDLRDGVGDFRLLSRKAVNAMLKLSEGNRFSKGLFCWIGFDQKIVYYENVERKNGKSKWSFRHLLNYGIDGIVSFNNRPLRMCFYAGIFILFLSLIYIAATFIRILKYGVIVPGYFTIISAVLFLGGVQLLSLGIIGEYIGRIYYETKKRPHYLIQEANIAHGETHENRES

SEQ ID NO: 5026 - protein, 129 aa, Bacillus licheniformis
MKIVNPEFIRFAVVGVVNTLNYYAVYLLLHVLLQLNYMVSHIAAFFVSLVISFFLNCYFTFKIKPTLAKFLQFPLTQLFNLTVSSLFVYTFVNFFKMNSEAAPLASMFLTVPLTFLVTGKILKKDRGRV

SEQ ID NO: 5027 - protein, 861 aa, Bacillus licheniformis
MKKTVFLFVIASIAVSVAAHSFFLYEWAHDRYMTGNGDGLAQMIIFKSFLFEQYKQGNFFYSYSFGLGGGIYSQLGYYFTTSFVFIASFAAVFLMQLLHLAGDADPLFWAQAAVFISVIKLSLIILAAAYALNGMVKNKLAAFTGAVLYGTSVIYFRHTVFWEFFSDAMLWLPLLVAGAEKVIREKRTALFITACSLTLINNFYFAYINLIFIAIYIIFRWLIRLDPEKEAPRWKQFRMFAASGLISFGISAISFVPAVYGFLNNLRPPYDQAVAVYDLTDNILFSSRIVLLPAVFMLFLFAFSFYKNKTFRLFASISVLLVLLHYSPLAASAFNGFSAPQNRFEYLLAFTIGGAAAAGMTELKNIRRKEMIWSILLVLLVYIAVIWRKDLDLSLMQNWSIIVLLFLTIAIFTAAGFQYKKSQLFLHVCILLSSVLVANTYQKYVLSESSGIKNVTKSYLTSNEYNGEEQRRLLNNIRKDDKGDPYTRIDWMNGVRNNTPLMQDFNGFSAYSSILNRDLLLFYWEDLQIDMGRESVSRYASMGDRANLYSLLYGKYYMTEKDNAANVPYGFIQTDESEHYTVYKNKYTLPFIRTARTLFTEKALADAPVLAREHAMLEGIVLENGGNGKEQPPSVPDLMKQTKLKTEGASYHNGFLDVTAENGGIDLIPEGGVPKEGDYYVGFYLKSLAKDQFFNLRVNDYVTSRKSNQSIYKTGVYDLTIRVPKTDKISIRLPKGKYQLDHLRLHQEDYQLLKKAAAKKTPAADLNWRNNQVSISFDNQNGDRYMVLPVPYEKGWEVTVNGKTQTVQKANYAFIGIPIEKGKNNIRLVYYPPYFKATLAVTVISLIIGIWYSRRRKKLGS

SEQ ID NO: 5028 - protein, 327 aa, Bacillus licheniformis
MDTGTHVVMGVALGGIATLDPVVGMDPSMAQAVMIATIAGSQAPDIDTVLKLKNNAVYIRHHRGFTHSIPAVLAWSLMIPGILMLFYPEANLLHLWLWTLAAVALHVFVDIFNAYGTQAVRPFSRKWVALGLINTFDPFIFVSHLIAIAFWLAGAHQGYTFLALYIVLAGYYLVRYFMQRKIKHELREKIDDIEEIIISPTMKFRQWRIAVKAKSAFYVGRSMDGNVVIVDTFNRVPLPDTDVMKAAKQDKNISAFLSFSPVYKWEIDTYKDHYEVRFIDLRYRSKGHYPFVAIAHIDRDTLELITSYTGWIFSEEKLQKKLKLGSV

SEQ ID NO: 5029 - protein, 361 aa, Bacillus licheniformis
MMDLQKKLEQKNIKQFQEDLISWYEQEKRDLPWRSDSDPYKVWVSEVMLQQTRVDTVIPYFNNFIEKFPTVEALAEADEEKVLKAWEGLGYYSRVRNLQSAVREVHERYGGVVPPSKEEFGSLKGVGPYTRGAVLSIAYNQPVPAVDGNVMRVMSRILSVWDDIAKPKTKTLFEKIVEAFISEEKPSEFNQGLMELGAVICTPKSPSCLLCPVREHCSAFAEGCEKELPVKSKKKKPSVKTLAAVVLTDEEGYIYIHKRPASGLLANLWEFPNTETQKGLKYEREQLAAFLKEEAGIEAEIGPLEGVVEHVFTHLVWNISVFFGKTLDQPDDSYFKKVTKEELAEYAFPVSHQKIWNMYMK

SEQ ID NO: 5030 - protein, 74 aa, Bacillus licheniformis
MYVGRDMSELDHTPKNEWKDAELLYFHRAFQQIMPFLNEEGHAEYLEVVKEIQARGGLCRQEADYTHGTTIQYD

SEQ ID NO: 5031 - protein, 250 aa, Bacillus licheniformis
MEQRKCALITGSSRGVGKAAALRFAENGYNIVINYARSKKAALETAEEIEKLGVKALVVKANVGQPAKIKDMFQQIEEAFGRLDVFVNNAASGVLRPVMELEESHWDWTMNINAKALLFCAQEAAKLMEKTGGGHIVSISSLGSIRYLENYTTVGVSKAALESLTRYLAVELAQKNIIVNAVSGGAIDTDALKHFPNREELLEDARQNTPAGRMVEISDMVDAVEFLTSGKADMIRGQTIIIDGGRSLLV

SEQ ID NO: 5032 - protein, 54 aa, Bacillus licheniformis
MANQQSKTNAQKVRQQNQASAQGGQFGTEFASETDAQQVRQNNQQAEQKKQQNS

SEQ ID NO: 5033 - protein, 81 aa, Bacillus licheniformis
MPEFENLVQGQMEIMDKLLYLQAEIERCQKIEKELAALEKKAQLLSIREDISQKRKDLAQIQDLFQKQTEQVIQAYQRIEA

SEQ ID NO: 5034 - protein, 176 aa, Bacillus licheniformis
MGFPKEGETIQIHSYKHNGQIHRIWNETTILKATELCIIGANDRTMVTESDGRTWVTREPAICYFHAKQWFNVIGMLREDGIYYYCNISSPFALDDEAIKYIDYDLDVKVFPDMTYHILDEDEYADHKKAMNYPKEIDGILRYHLNTLLHWIHQRKGPFASEFIDIWYERYLHYTK

SEQ ID NO: 5035 - protein, 580 aa, Bacillus licheniformis
MGVIRRYMEFVKPYKWKIVLTVLIGIIKFSIPLVIPLLLKYVVDDIIQGSGTAEEKTSTLFMVMAVMFAIFLVLRPPVEYYRQYFAQWTASKVLYDIRDKLFAHIQKLSLRYYANTRAGEIISRVINDVEQTKEFVIIGLMNVWLDVMTIFIAIAIMMTMDVKLTLISIVLFPLYGLSVKFFYGRLRKLTRERSQALAEVQGHLHERVQGMPVIRSFAIEDYEQKQFDHENGNFLGKAIRHTAWNAKTFAVVNTVTDLAPLIIITVAGYHVIHGNLTVGTMVAFFGYIERLYNPLRRLINSSTTLTQSIASMDRLFEFIDEPYDLKDKPNAVKAERLKGIVEFKNVSFQYEKSEEMILQDLSLKAERGETVALVGMSGGGKSTLVSLIPRFYDVSAGSLEIDGIDVRDYEARSLRNQIGMVLQDTFLFSESVRENISIGNPEASMEDIIEAAKAANAHDFIMELPQGYDTKVGERGVKLSGGQKQRISIARVFLKNPPLLILDEATSALDLESEHYIQEAMEKLAKDRTTFIVAHRLSTITHADKIVVIENGRVAEIGTHDELMSRDGHYKHLFTIQKLN

SEQ ID NO: 5036 - protein, 326 aa, Bacillus licheniformis
MTKEKLLEVSDLSISFQKKKSETPIVQGVSFDLHPGEIMGVVGESGCGKSVTSLALMGLNANTRTTGRIKFQNKDLLMQSEKEWRQMRGNDIAMVFQEPMTSLNPLFTIGDQLTEALSSHTNIHKKEARRKAVQMLDTVGLPRTDQLMKQYPHELSGGMRQRVMIAMALICEPKLLIADEPTTALDVTIQAQILSLLKKMNAEFNTAILLITHDLGVVHNTCERVMIMYAGRIVEEGGVTAVFDSPKHPYTKGLFASIPAFTGKSERLSSIEGQVPKPGSIKKGCMFAPRCPHKRERCVEEEPGLNRLADDHAVSCFLYEEEGAFT

SEQ ID NO: 5037 - protein, 318 aa, Bacillus licheniformis
MNHELLNVQELKTYYRVSRKKIVKAVDDVTLSVKKGEIVGIVGESGCGKSTLGKSILRLTEPTSGKVTFLGREMTGLDAKQLRNMRRHIQMIFQDPYASLNPRMKIKDILEEPLIVHKLGTKAERREVVRSMLEIVGLDASYGDRYAHQFSGGQRQRIGIAKALITKPKLIIADEPVSALDVSVQAQILNLLSDLQEAFNLTFLFISHDLGVVRYISDRVAVMYFGKIVEMADADSLFREPKHPYTETLLAAVPVIGKGEAVHTAPDIAAPRMSEKGCPFYSRCMKRADVCLEAEPLLEETADGHYAACHFTNKEAVR

SEQ ID NO: 5038 - protein, 532 aa, Bacillus licheniformis
MKKKSWLICLGMILSVSAFLMGCSGNESGKNDGGTNGGKDTLIIGRGGDSTSLDPITTTEGEAFKVTINMFETLLNYGEQDTTLKEGLAVKWDASDDGLTYTLELRKGVKFHDGTDFNAEAVKYNFERWMNGDEEKFPYYGMFGGYKKDEGHVIKDIKVLDDHKIQFILKRPQAPFLKNLAMTSFGIASPAAIEKYGEKFREHPVGTGPYKFVEWKPNDRIVLEKNEDYWDQGKPKLQKIIFRAIPENSARLNALKTGEIDLMDGVNPSDIESIKADANLKIFERPSMNVGYLGMTTTRKPFDNKLVRQALNHAVDKQAIIDSFYGGLAESAKNPLPPSLEGYNDQVKEYPYDLKKAKELLKEAGYPDGFKMKLWAMPVPRPYMPDGMKIAEVIQSSFEKIGVKAEIVTYDWATYLDKVSKGEADAFLMGWTGDNGDPDNFIYTLLDKDNIGGNNYTYFSNDELHDILIEAQSDPDQKKRNKLYQDAQELLHEESPWVPLVHSTPILAGSKDIDGYVPHPTGSEVLSGVEFK

SEQ ID NO: 5039 - protein, 333 aa, Bacillus licheniformis
MLAYCLKRTAMLIPVLIGMTLVVFSIIRFIPGNPAQVILGQRATKEAVQQLTVQLGLDQPWYMQYARYIGDLLKGDLGTSIRTGAAITQEIKPYLFATLELAFFAMLIAVFVGVNAGIISAWFKNSVFDYIAMLVALIGVSMPIFWLGLMGQWFFSIELGWLPTTGRENVRNPVEAITYIHTLDTLLHGRFDQFAEAIRHLILPGTALATIPAAIIARITRASMIEVLQSDYIRTAKAKGVHMFFVIYKHGLKNAFIPVLTVIGLQTGLLLGGAILTETIFAWPGIGRYIYDAISYRDYPVIQSGILVIAFIFVMINFIVDLLYAVIDPRIKY

SEQ ID NO: 5040 - protein, 296 aa, Bacillus licheniformis
MVVLQNEQQREDVKVRSPLAEHIRRFFEHKLAAAGTILVALFILLAIFAPLIAPYGINDQSLSDRLAAPSAEHLFGTDDFGRDIFSRVLYGARLSLWVGFFSCLASALAGTLLGLIAGFYGRWADALISRLFDIMLAFPSILLAIAIVAILGPSLENALIAIAIINVPTFGRLVRSKVLSIRQEEYILSARAVGMSNIRLMFKHILPNSMAPVIVQATLNIGTAIIEAAALGFLGLGAQAPNPEWGKMLADARPYLAQAPWTLFFPGFAIMLTVLGFNLMGDGLRDTLDPKMKEGK

SEQ ID NO: 5041 - protein, 356 aa, Bacillus licheniformis
MKLGARIFKTGIAITLALYLASWLGLPTPVFAGIAAIFAIQPSIYRSFLTIVDQVQANIIGAATAIIFGLIFEPSPIIIGLTAVIVITINLKLKIENTISIALVTVIAILESSGDNFLWFALVRTGTVILGVLSAFLVNLIFLPPKYETKLVSHIVENTDEVIKWIRLLTRKTTEHSMLKEDIEKLKEKMMKVDHLYLLYKEERSYLKRSTYVKQRKLVLFRQAIIASNRALDALKKLHRLENEFYHMPEEFQETLVEELDYLLHWHERILMRFVGRIKTQDHVDLHEEGDVYKQHLTESFLKNQDKLKEELLDYNMLTIMASTVEYREQLEHLETLLSSFQTYHKKDSELEVEEE

SEQ ID NO: 5042 - protein, 432 aa, Bacillus licheniformis
MQHTQSEKLHEEALQHIVGGVNSPSRSYKAVGGGSPVAMERGSGAYFWDVDGNKYIDYLAAYGPIITGHAHPHITKAIQTAAENGVLYGTPTKHEVTFAKMLKEAIPALDKVRFVNSGTEAVMTTIRVARAYTGRTKIIKFAGCYHGHSDLVLVAAGSGPSTLGTPDSAGVPKSIANEVITVPFNDIDSYKEALDKWGNDIAAVLVEPIVGNFGIVEPKSGFLEQVNELTHNAGALVIYDEVITAFRFMYGGAQDLLGVKPDLTALGKIIGGGLPIGAYGGRKEIMEQVAPLGPAYQAGTMAGNPASILSGIACLEVLKEKGTYEKLDRLGAMLEEGILAHAETHGIDITVNRLKGALTVYFTNEKVENYEQAENTDGDMFAAFFKLMLERGINLAPSKYEAWFITTAHTEEDIKDTLKAVDDSFKQLKQRM

SEQ ID NO: 5043 - protein, 157 aa, Bacillus licheniformis
MTVEIGQKVPDIELLGDHGEKVKLSDFEGKYVVLYFYPKDMTPGCTTEACDFRDRHESFAELDAVIIGVSPDDQARHEKFKQKHDLPFLLLVDDEHKLAESFDVWKLKKNFGKEYMGVERSTFLIDKEGRLVKEWRKVKVKDHVAEALQAVKEIAEA

SEQ ID NO: 5044 - protein, 145 aa, Bacillus licheniformis
MAEHNLKEALEALKETGVRITPQRHAILEFLVNSMSHPTADDIYKALEGKFPNMSVATVYNNLRVFKESGLVKELTYGDSSSRFDFVTSEHYHAICERCGKIVDFHYPGLDEVEQLASHVTGFKVSHHRLEIYGLCQECDKKESH

SEQ ID NO: 5045 - protein, 87 aa, Bacillus licheniformis
MDMAKYSSKINKIRTFALSLVFIGFIIMYVGVFFRSSVLLMSVFMILGVLSILLSTAVYFWIGMLSTKAVQVVCPNCEKPTQDFRPG

SEQ ID NO: 5046 - protein, 294 aa, Bacillus licheniformis
MENLLRPIYQERASRPDTLAVMLIERRNQTSSATDNFDAALLIIVNKAEDPVFVKHYEFDGKTASLHIISVEQLQEWILLGTNRRIIDWVLNGKVLFDRNEFIAKLIEQLNTFPFSERKLKIGLEYGKLIRRYIEGKSFFEDGQFLDAYNSIVHALHHLARIEVIDKGFHPEVTVWNQVRHMEPQVYKLYKELIESNESLQKRLELLFLASDFLIHSKAEIGAAYILNVMDEKSVWQFAELLKHPDLKYFTTDLGVILEFLAEKDLVGVKPIETKGQKIFHRGYFIKKSVDTNL

SEQ ID NO: 5047 - protein, 346 aa, Bacillus licheniformis
MKAAASVNVANLINQWYVHIKKRDVSNAVELRDRIKGLLNVMEEDQDVLLYFNLLDYRFRVLMEDVAGEPQLPPIAEDKAKTDGLLRYYYFLFKGMYESARSNYSKALNCFRVAERQLDNVEDEIEKAEFHYKLGNLYYFTKTTLLSFHHLSIAKSIYRAYEEYKTQSINCTVLLALNYIDDGRLTRAENMLKSCAERLIKMGDNHLLAAVYYDLGFLKIQEDKHEEALEYFDLSFKTDDIEKNAPIMYMQCIYESARSTYKIGEVDKALKWVHLGFEFAQKTDNINFSLKFSILNICYSAPIEGVPQVKEFIEMLEEREAYVDIEALAEDVANVYSSLNNYKYST

SEQ ID NO: 5048 - protein, 69 aa, Bacillus licheniformis
MEQQAFLLTSAVFDQHQHPLKFIQKVINVELILVEINFLHRLPGLMKKSIIFKVREPPDESIYFHRVIP

SEQ ID NO: 5049 - protein, 58 aa, Bacillus licheniformis
MFSSVVFEQKLFSKERMFIVRACMYVVYTFAWMVIFVSLGETLKKSLIWIITKICLYG

SEQ ID NO: 5050 - protein, 41 aa, Bacillus licheniformis
MIFCRKSRRALTISSRCKLVIPKKDDDKPKSKEEERFGGRM

SEQ ID NO: 5051 - protein, 71 aa, Bacillus licheniformis
MQEVTSEILIERYGLSEKILSGEIKACQKHKWAVQRFFKDVEVLADPDCPYYFDAEAVLDFYEWARQVQTC

SEQ ID NO: 5052 - protein, 91 aa, Bacillus licheniformis
MNRYCEISRPLWWIKQPATSAPKKKARKSRSKKVPIPPGIYKSLIMKGTAVRQIQEALAALYFYPDKGAKNNGIDVYYGTKTKAQLESLLV

SEQ ID NO: 5053 - protein, 112 aa, Bacillus licheniformis
MEPDSLFKTLLKYKDRELILEWENGLRVIGKTDTFFETDNGLEDDDINYKEYYATAFQVNKVLSPPVNNEEDSLYNWLLEEKNSLVEISLYEDTPNKILVDGNTIWELDSDE

SEQ ID NO: 5054 - protein, 574 aa, Bacillus licheniformis
MKTLDVQALHNAIDQTLEQLKQQSDEIAKVKKAVEGITSLDDALKGKGGDAIRAFYEECHTPFLQFYDTFIEEYSSALKKMKSALNSLEPNHNGFISQSFLGHELENGLNAADRTTKHLVSKTNATIAKVSHIVDLPDLNDSGFHEQNQKALKEISTTLEKLHAFDRGQTNALKTAENDLETMQRYIARLEKMYTGPKIEITSYQKGAILKSDDNSTINGLPGGLQGQLENVEPSPMEMMLEKLNKNKRSNVDTVIREDNKENINQDVYANDFDLNALQNEAEKYPKVYGDIRVIDGKLYNHKGWKRVKTVDVADEVVQNPADIKYIGGRYHVYENGQIVREYIVNGKVEMEAVKRIPKSRSQGNLKRDFEGTPLEPVNDIGDFVAKEIAGGNDAVRVITGRDPDTGEKVSNVERAASGTSLTPVGRLLKYGKKGFKLFKGEEAGKKVAKVDKTPSYGKQSVPKGPYREVNGFPAKVKPGAQEKHIPGTPNYKQEVANGRTKSIFYGDNKKAQELLDKYAGTGDMLKKGNKERVDFGQVIGKYYNTETRKYEETTRGMIHYGKNGAHIVPSQPS

SEQ ID NO: 5055 - protein, 79 aa, Bacillus licheniformis
MVLGEMKVDARFLPDIYNRIRQIKVNHGLSSWFEVKWTKVSMSKIDFYLDLIDYFFDTAALSFRSVVATGKKEVRPQYI

SEQ ID NO: 5056 - protein, 146 aa, Bacillus licheniformis
MWDLKEQILTAAKSVDIKVNELSTNDTEIIFHNLANKYANGKKHFPLWEFVEKDFSVQNQDAWQWIADYIADSEAILMFNPSDEKSSYKIDGGNNVVKILSEMFNVEFYVTNKNNDYLLSFNHHDILSACGNAKEWLKQYNPQQQD

SEQ ID NO: 5057 - protein, 519 aa, Bacillus licheniformis
MKTLDVQALHNAIDQTLEQLKQQSDEIAKVKKAVEGITSLDDALKGKGGDAIRAFYEECHTPFLQFYDTFIEEYSSALKKMKSALNSLEPNHNGFISQSFLGHELENGLNAADRTTKHLVSKTNATIAKVSHIVDLPDLNDSGFHEQNQKALKEISTTLEKLHAFDRGQTNALKTAENDLETMQRYMARLEKMYTGPKIEITGYQKGSILKPDEMDTLSGNQETAMGVMLKKVGDKEDADINTLADPDRLKKLATQVSKKVYTDEELENLSEKELEKLKKVYKYVNGHKYCYYLDGKYVVGIQLVDDPPAEDKEVSDLEKYSRIGLELLGESDFERAALGYDPDTYKKLSLFERFEAAVNLTPPLRIVKWIRKGDKLAKVSKVDKGAKTAGDVGKKTAPVATKEKNTKLGSITGYKFKKGIDLDFRGTGKTYKDALDEAFKRTGVPKKEFKVTKWGKDENGKSFPVEWRSKNGAEVNIDVGHTKNGPDVPHTGYQTAGKRGGGGAIRGHILVDSVPINR

SEQ ID NO: 5058 - protein, 372 aa, Bacillus licheniformis
METIPSSEVGIKINRWYNEIQKLNVIEAERLKAEVHLAIERMEEDQDLLSYYQLMNFRHELMLEYLFPAEKKLSKSDYLREIEGQGRKLSGLLEYYFSFFTGMYHFSRGKYIKAIKAYRAAEKKLTKVSDKIEKAEFYYKMAEVFYHMKQTHMSMYYVSLAYDIYKSYDAYVIRRINCLFVVAGNYIDLSTHDQALPHLLSAKESAEDIQNKAIVAKALLNVAYCYNAMERPTKAIEYFHKAIDVAKEIKAKELTQAYYDLALIHFRNNENIEGRKFYEKALESARVFEDELFLCLLDVLEALFIKSANKSEVLETMKPLRDSRGYPYLEELALEAALFYTRNERPNDSIFFYDQMVQAQKQIKRGDFLYEI

SEQ ID NO: 5059 - protein, 441 aa, Bacillus licheniformis
MSIRIKLPDGSVREFEEEASIEDVAASISCGLEHAVAGKLNGKLVDLSTPLQDGALVEIVTRDSAEGQKIVREKSRGKGRIVALDAARGLAVIGMYLQHFALNETNGSIVSGNTTLLFVLCGGISYSIMAGRMMDRGMEPAAFRTRMLARAVFIDMIGYLLIMLNTPFGVILPAYAALFVLALVLIRRSTRVLVTTAAVLLAVSPPLMILGGSVLSGANLLGDIAGGPMSALALAPAFVAGMAIGRFDLTRMRTALSLVSSGAVMLIVSKLLGVFVLPWLSRSFEEWLVSVQGTAGAEPDQYAIWPHNVAPPLWHNLLSIAPHSASTFQTMLGLGAAFLVLGMVCLVPQKISAVLKPFAGVGRVALTMYAAQFVVIWALEISGAKYDIGAIPFGDLFVAAVATVTGWLIARLPTGPLETAMRRFDRAFSNLGPVTGPARLR

SEQ ID NO: 5060 - protein, 254 aa, Bacillus licheniformis
MKKLVKVRGITLGEGRPKICVPLVGKNLAQLKEEAAYFQTLDADIAEWRADFYEDVDDVDQVCAALAEIRGLLKDTPLIFTFRSAAEGGEKEISTARYFSLNEAVVKTGLADVIDIELFNDEEQVKALVETAHGHEVSVIISNHDFEKTPAAEEIVSRLRKAQELGADLPKIAVMPETTADVLRLLEATCTMNEKYADRPIITMSMAGKGIISRLAGEVFGSAMTFGAAKKASAPGQIAAGELKEILHILHRNL

SEQ ID NO: 5061 - protein, 598 aa, Bacillus licheniformis
MKQESVQQKNISIMSSFSGSRKVYVEGSRPDIQVPMREISLSPTTGSFGDEENQPVRVYDTSGPYTDANADVDILKGLKPLRATWIRERGDTEEYEGREIRPEDNGYKGKEKASHSYTGLKRKPLRAKKGQNVTQLHYARKGIITPEMEFIAIREHVSPEFVRDEVASGRAIIPSNINHPESEPMIIGRNFHVKINANIGNSAVTSSIEEEVEKMTWAIRWGADTMMDLSTGKDIHTTREWIIRNCPVPVGTVPIYQALEKVNGVAEDLTWDIYRDTLIEQAEQGVDYFTIHAGVLLRYVPLTAKRVTGIVSRGGAIMAQWCLAHHEESFLYTHFEEICEIMKTYDIAFSLGDGLRPGSIADANDEAQFAELETLGELTEIAWKHDVQVMIEGPGHVPMHKIKENVDKQMEICKEAPFYTLGPLTTDIAPGYDHITSAIGAAMIGWYGTAMLCYVTPKEHLGLPNKDDVREGVITYKIAAHAADLAKGHPGAQIRDDALSKARFEFRWRDQFNLSLDPERALEYHDETLPAEGAKTAHFCSMCGPKFCSMRISQDIRDYAKENNLDEEKAIQKGLKRRRRNLKKQAAAFTVKSGQYSR

SEQ ID NO: 5062 - protein, 255 aa, Bacillus licheniformis
MSLSIRVNEKAFGKGSFKTSVLQDVNLTVENGEFLTVIGPSGCGKSTLLKIAAGLDGDYEGRISMNGREIKGPGIQQGFIFQEHRLFPWMTVEQNIAADLSLKEPAVRKKVDELIETVRLKGAEKQYPRELSGGMSQRVAIARALLREPEILLLDEPFGALDAFTRKHLQDVLTDIWREKKMTMILVTHDIDESVYLANRIAILTAKPGRIHKLIPVDLPFPRSRTSPVFQTIRQKVLKEFETTETFSFQEGSGI

SEQ ID NO: 5063 - protein, 329 aa, Bacillus licheniformis
MKKWPLYVLGCLLLLAGCSAAKSSEGGGDLKEINIGVQQSLSPLLLAKEKGWFEKEFAKEGIKVKWTEFQSGPPQFEGLAADKLDFSQVGNSPVIAGQAAGIDFKEIGLSQDGLKANGILVKKGSGIDDIKDLKGKKVAVAKGSSGFDFLYKVIDKAGLKPTDVNIIQLQPDEAMPAFDSGAIDAWSIWEPFLSLKTIKSDADILVDGEQIDKYSPGFTLVRSKFAEQHPDEVIRFLKVYDKAVKWQKTHKKEAVEAYAKIKNLDKEVVENVLNNTEPLNEPITDRIIQTQQETADFQYKLKAINKEIDVKEVVDNSFIKKALKEGDDK

SEQ ID NO: 5064 - protein, 278 aa, Bacillus licheniformis
MRAVSSSTPSIQPKTGAKLRPAAFRLAWGKGFVLPVMLILLWQLVGSLELISKTVLPAPLDILLTFRDLIVSGELFTHLGISIQRAALGFFLGAGLGLLLGLVIGFSKIAEDYLDPSLQMLRTVPHLAVTPLFILWFGFDELSKVLLIALGAFFPVYINTFSGIRGVDSKLFDVARVLEFHWLKQVTKLILPASLPNILLGIRLSLGVSWLGLVVAELMGSSAGVGYMIMDARQFSQTDKVFVGILIFAAVGKLTDSFVRILEKKCLGWRNSYQGNKK

SEQ ID NO: 5065 - protein, 152 aa, Bacillus licheniformis
MDILWFIPTHGDGRYLGTNTGGRAADHTYFQQVAQAADRLGYTGVLLPTGRSCEDPWITAAALASVTKNLKFLVAVRPGLMQPSVAARMASTFDRLAEGRLLINVVAGGDPYELAGDGLFISHDERYEATNEFLDIWRSLLKARPSATQGNT

SEQ ID NO: 5066 - protein, 240 aa, Bacillus licheniformis
MAVAFKGETVSYSGKHLKTENGRLLFPPAQQPHPPIYFGGSSKAGQETAAKHADVYLTWGEPPHLVKEKIQSVKKKAEKEGRTVRFGIRLHVIVRETEKEAWQAADRLISRLEDETIAAAQNAMKRMDSSGQKRMVQLHQGNRSNLEISPNLWAGIGLVRGGAGTALVGDPETVASRIKEYADIGIESFIFSGYPHLEEAYHFAEKVFPLLPFRTKLQSKASGEVIGNDHFPSRQKEKTV

SEQ ID NO: 5067 - protein, 152 aa, Bacillus licheniformis
MNMITRTFFHILLFGLACWTFITFFHTSEQIAKSLKTNDSELHFVFNLIPILLFGLVLSIYTYLEKKSGSRKQRFMLVPDEFKEQDEREQMITAKACRTSYIVLYVAMPVAALLLIFYPFFQVRIPSFPIIVIFMLIIIQHLSYMFSFYKNR

SEQ ID NO: 5068 - protein, 68 aa, Bacillus licheniformis
MNNRVRELRARYGYSQEALAKAIGVTRQTVAAIEKGNYIPSLLLALKICKEFQLKMEDVFWLEGDKNE

SEQ ID NO: 5069 - protein, 70 aa, Bacillus licheniformis
MTYAAPQVDYSVNPSIEDQAWFLVFVAVLLALGATVVLGAAVWCVANGNGSFTGSVKWVSGLQVSIECRK

SEQ ID NO: 5070 - protein, 248 aa, Bacillus licheniformis
MFIIDHLSKTYKNNVTAVSGFHIKIEKNQIVAIAGPNGSGKTTIINSILGIITPTEGTILLDDLPNTTAEFKQKFAYVPDELLLPDALSAAEYLDFVSSMYHCTSNEKRKQLIELFDMKEALQEPIETYSHGMKKKTQLIAAFMLESEFVIMDEPFRGLDIEAVINTKKLMKRYAATQGSILLATHDMLSAEELCDKIAILSKGVKMDEGKVKELKAKYNSDSLEEVFLKASMLSDRGAHFDQIIRNF

SEQ ID NO: 5071 - protein, 486 aa, Bacillus licheniformis
MIKSFEISKMMLKMWQKEMGKLFNTGTKKAIAVLFLLLAVTMGSIIGYSFTGMFLSAFLNGEVRSLGLFVISMFMNASIFTFVFFILFKVRTPEQHSFSMQLSWFPLTAFQRSLGYFIPFAGAVSFLVLFMIFILLIPNFVASGVGFWFAFAFFALLFVQIIFFFSLLNLVYNLVYMLILKFGFPLQKFFSMFVLVVLAVFYGITSFDLGNIQNAYSSFDYHLTYFAAPLFLMLNGQASDAGVIPIVLILTAAVTASFMSLNVVPILTEKKSSKLFSFIKIPSSKPLSLAVKEIKSQARNEENILNFIFLLLALCFLKYKFQFGFTGESYLVLGGVTGIIAFNSFGNDLRMMQMYKALHLKTATVLWSKYLGLCMLGLIQLFLFSVLTWTFPESFPVFLKTVAVILNSIAMFYLAGIIFPLDRNNPYMGIFSFGMLLLFLIPLFFIVNYAVDNVTGEALLFFIPCLELLLILLLYGGFKWRYHYDH

SEQ ID NO: 5072 - protein, 255 aa, Bacillus licheniformis
MIINMLKSLAGIKKIPYFPEHVTLNRKHISDHDLDADFPINPTAYQMLKEVDGKKDELEIAEALKGVFNVREEVLQKDLHELLTGLNRRYLINWRYGEGPSFAGVLYQFFSQYHIRYKERFSSHSDSFLLLYIKFLQVISKKIIVFWLVFLMLSLAAYTVVPDGSIVGIAAYFSVVYFGLITGTALHEVVHGIAHRKAAGRNGPQGFLAADMMSVKFVRPVMSLHDKRSIWITALGPLVPRCARNSRRAVYGLFS

SEQ ID NO: 5073 - protein, 65 aa, Bacillus licheniformis
MFPGVLGIAGVLFTVFFLKENAVSVGVLLFFSTYALHMMYLLPFMGDGKSIMKQLMIRGIGGKSS

SEQ ID NO: 5074 - protein, 94 aa, Bacillus licheniformis
MNTNSLKQGLIFASFSSFLAFPMLAAALLFYHLFSNQTSNDILFNSLSFVMESESAFSFQVKPNFFFIMIGLFIGIFIITAAISSIYQKKKGES

SEQ ID NO: 5075 - protein, 89 aa, Bacillus licheniformis
MAKKSKIAKEKKRQKLVEQYAELRKELKEKGDYRALSKLPRDSAPARLHNRCEVTGRPRGYMRKFKMSRIAFRELAYKGQIPGVKKSSW

SEQ ID NO: 5076 - protein, 209 aa, Bacillus licheniformis
MELRLQIAPAILNRIPSFKVGAVLYQGIEINGSPQMLKGRLRLFQESLFFDYADRSIEDESAVKEWHDAFRELNPSFSGRESGLERMLEDIKEQRFVEPKNSAVDLSRFFSLKYLIPVHIYDARNLKGPIKIEPGGPDEIITFSDDAGAFGTITENLSLHHAGADTKDALQLVFFRPSLSKEEASRLLDSLTKMFEQIHGGRHISAVFP

SEQ ID NO: 5077 - protein, 382 aa, Bacillus licheniformis
MDVKKLKQDVIEFAQQIGIDKIRFASADTFETLKERLIENRALGYESGFEEPDLEKRTNPDLLLPKAKSIIAIALAYPSKMKDAPRSKKGERRGIFCRASWGKDYHHVLREKLDQLEEFLKAQRSDVRTKSMVDTGELSDRAVAERAGIGWSGKNCMIITPEFGSYVYLAEMITNIPFEPDERIEDQCGSCNKCIEACPTGALVKPGQLNSQRCIAFQTQTKGFLPDEFRTKIGNRIYGCDTCQMVCPKNKGVDFHLHPEMEPDPEIAKPLLKPLLTMSNREFKEKFGHVAGSWRGKKPIQRNAIIALAHFKETDALPELIELMHKDPRPVIRGTAAWAVGKIGGADVMSELERALAHEQDEDAKAEIQKGIGLLKETSATN

SEQ ID NO: 5078 - protein, 301 aa, Bacillus licheniformis
MKQIIEQLLKARLQYLINGNDETNWRDAGGFEVIERKRRLFQKRGVHIVKANIEAAVKEHWLDEDGASHVNYQTHTAYLCKDGDDMYMEEHMEDRNALLYDQMVIKDSEALRPAAQSHPEPENGDEDMRELLGRAFRYDRLAAVRYAETYWNKRNPAYKNFEDNCTNFISQCIRAGDAPMRGYPNRGKGWWMQNHSWSYSWTVAHSLRTFLKHSKAGLRAVQKPAAKELIEGDVICYDFNGDGRFDHVALVTAKDKSNMPLVNAQTHDCRMRYWSYEDSPAYTSSIRYAFFHISDDTTKSK

SEQ ID NO: 5079 - protein, 157 aa, Bacillus licheniformis
MALHVVLYQPEIPANTGNIARTCAATDTTLHLIRPLGFSTDDKMLKRAGLDYWEFVNVVYHDSLDELFDAHPEGRFFFITKFGQKPHTSFDYSDQNEDYFFVFGRETNGLPKELIEQNMDRCLRLPMTEHVRSLNLSNTAAILVYEALRQQNYRDLT

SEQ ID NO: 5080 - protein, 212 aa, Bacillus licheniformis
MCVKELKQMVQDDLISKKELLDLTSISYGQLYRWKRKNLIPEEWFIRKSTFTGQETFFPREDILKRIETIQSMKENLSLDEMAEMFSPDLTELNASRGELLKKGIVSEAVMAFFEECTGKRDHPFNLTEALAAYVLEGLLQSGDISLDEGKMVLDVIMSNEAENKGRLLVLRKLGVATCLIAEGSIVLEKGVKVAADINLAASSEELKTKFM

SEQ ID NO: 5081 - protein, 236 aa, Bacillus licheniformis
MENLLINGFGSSGGGAYQTVELNGKGTINGDIDCERFSCSGTGTVNGDVKADELRISGHAKLNGAIEASKVRIDGSAKVDGDVEAEKLKILGYAGISGHVKGDEAIVRGKTSIGKDCQVEHFSAEGYFTIDGLLNAEQIEIKVHGGESKVKEIGCRRIVCTAHQSKLFSFLSELISPPRLSAELIEGDHIELANTTAKVVRGNSVIIGENCDIGLIEYKEDIRVAETAKVGEKRKL

SEQ ID NO: 5082 - protein, 233 aa, Bacillus licheniformis
MKKHDLKIHGSGSAGGGSFHRVLIRGEGMITGNIDCEKFSTHGTSELSGDAKIKSFSVHGETEIRGRLKADKARVYGTADVSENAEISDAAVKGIINIGGNMTADTCDVKGALNVRGDCEAEDFKLTGSLDVKGLLNAGVIDIGLKYGNSSIGDIGGTDIKIVNKRGLLFNRNGGTLSAGTIEGDDIYLENTAARMVRGNRVHIGPGCKIEKVEYKSSYRVSPKSEVNEDQQQ

SEQ ID NO: 5083 - protein, 28 aa, Bacillus licheniformis
MRTLIMMGVILAFLVSIFTAGYESKPGK

SEQ ID NO: 5084 - protein, 631 aa, Bacillus licheniformis
MDILKKIEQYREEEQRLKWEGTFAEYLEIVRENPTVAQSAHSRVYNMIKDSGIEEKDGKKVYSFFDKELFGLEEPLERLVEEYFHPAAKRLDVRKRILLLMGPVSGGKSTLVTMLKRGLEAYSLTDEGAVYAIKGCPMHEDPLHLIPQHLRDDFYNEYGIRIQGNLSPLNMMRLEQEYGGRIEDVKVERIFFSEDKRTGIGTFSPSDPKSQDIADLTGSIDFSTIAEYGSESDPRAYRFDGELNKANRGMMEFQEMLKCDEKFLWHLLSLTQEGNFKAGRFALISADELIVAHTNETEYRSFISNKKNEALHSRIIVMPIPYNLKVSEEERIYEKMIAESDVSDVHIAPHTLKVAAMFSILTRLKEPKRSDIDLVKKMRLYDGESVEGYNSVDVEDLKKEYTDEGMSGIDPRYVINRISSTIIRKNMESINALDVLRSLKEGLGQHPSISAEDRERYLNFISAARKEYDEMAKKEVQKAFVYSYEESAKTLMDNYLDNVEAYCNKIKLRDPLTGEEMNPDEKLMRSIEEQIGISENAKKAFREEILIRISAYARKGKRFDYNSHERLREAIQKKLFADLKDVVKITTSTKTPDEQQLKKINEVVARLIDEHGYNSTSANDLLKYVGSLLNR

SEQ ID NO: 5085 - protein, 388 aa, Bacillus licheniformis
MSHKDNGHFIISQEDWSLHRKGYDDQQRHQKKVQDAIKNNLPDLITEESIIMSNGKDIVKIPIRSLDEYKIRYNYDKNKHAGQGDGDSQVGDIVARDGSDKRGAGKGQGAGDQAGEDYYEAEVSLIDLEEALFSEMELPNLEQKERDDIVVEDIEFNDIRKTGLTGNIDKKRTMLSAFKRNAMTGKPSFYPIYPEDLKFKTWNDSVKPESKAVVLAMMDTSGSMGVWEKYMARSFFFWMTRFLRTKYETVDIEFIAHHTEAKVVSEEDFFSKGESGGTICSSVYRKSLELIEDKYHPTRYNIYPFHFSDGDNLTSDNARCVKLVGEIMEKANIFCYGEVNQYNRHSTLMSAYKNIKNEKFKYYVLKQKADVFQALKSFFNNEERHQYT

SEQ ID NO: 5086 - protein, 210 aa, Bacillus licheniformis
MSKGRLIATNIIGLIIVLAILAGGAYFYYDSISYVKTDEAHVAGEMADITAPASGKLADWDLKEGSKVSKDEKTAKIKGEQTVDVKSIMDGTIVKNEAKEGQIVQAGQTLAKTIDMDHLYITANIEENDLKDIEKGDKVDIVVDGDSGTTFEGNVEEIGYATNSTFDLLSQSNSSGNYTKVTQKVPVKISIKNPSDKVLPGMNASVKISK

SEQ ID NO: 5087 - protein, 529 aa, Bacillus licheniformis
MASQKKGNMSLLIILMAGLFLAILNQTLLNVAMPHLMTEFNVSATTIQWLTTGYMLVNGVLIPLSAFLIMRFGGRSLFLTAMLLFTAGTLICGISPNFSTMLTGRLIQAVGGGILQPLVMTTILFIFPPESRGKGMGIFGLAMMFAPAVGPTLSGWVIENYSWRIMFYSLVPVGVIVIIFGFFLFKNMTEPKKIKLDTAGAILSVVGFAALLYGVSEAGSDGWDDPIVLSTVVIGVIGIAAFIIQQLKSKEPMLDFRVFKYDMFSLSSVINAIITVALYAGMFLIPIYLQNLVGFTALQSGLLMLPGALVMLVMSPISGILFDKVGPRPLAIVGLLITVVTTYEFTTLTIDTPYMYIVLIYAIRAFGMSMLMMPIMTAGMNQLPQHLNSHGTAMSNTLRQISGSIGTSLITTIYTNRTTFHYASMADQTNTADPSFMSTLQSTIQSTAQSMHISLEQAQQYVVKYLTGQAQLNSNVMGINDAFMWAAGFCVIGLVLSLFLRDVRKDKLRRKNKAQELTLLPAPKEAKES

SEQ ID NO: 5088 - protein, 176 aa, Bacillus licheniformis
MKIYVVYDSEGEHTKKLAEAIAEGAGEHDAADVRIDHVSQADIRKLEEMDAIIWGCPGHFGTISSGLKTWIDRLGYLWAEGKLINKIGAVFCTTATTHGGLEATMLNLITPMLHQGMMVVGLPGNVPENALYGSYYGAGITCPVDSDELIGEEGLELGRALGRRVAQVADRFTAGQ

SEQ ID NO: 5089 - protein, 110 aa, Bacillus licheniformis
MTIILTIIAAVLVIIGLVVFNVRSASSQDKPEHEDKAASAAGIPQVQEEEEPEQVKADQQDPFEMNDQTYRAILQKLQQPKEEKKYPEKTEMDDMDYRNALKSMKKREQD

SEQ ID NO: 5090 - protein, 71 aa, Bacillus licheniformis
MSAQKIFGYQKIIRDISLLIYDAYGLFEALFIKSGLFQKVQRFWSISLNADFKFHDEQPERRRRTSLFNRA

SEQ ID NO: 5091 - protein, 69 aa, Bacillus licheniformis
MVRESTVKSLLTYLELDKQTIAIATYEIEQILDVVLNGRIEAKKDVEQLREESGMSLLEWLKRFIKEKN

SEQ ID NO: 5092 - protein, 307 aa, Bacillus licheniformis
METLLELKNVSKTIRGKKIIEGLSFDVRAGEIFGFLGPNGAGKTTTIRMIVGHMSITAGEIAVCGVSVKENFEKAARHIGAIVENPELYKFLTGYQNLQQYARMTKGVTKKKIDEIVELVGLKNRINDKVKTYSLGMRQRLGLAQSLLHDPKLLILDEPTNGLDPAGIREIRDYLRKLTREKGMAVIVSSHLLSEMELMCDRIAIIQNGKLRDIQHVHGPARDEKKRYYIQADDTQALTREAAAFRKVKVDEAEGGIELSIQKDEVPDLIKHLTDSGVRLYEVKAVNKSLEDRFLEITADKEEAQHV

SEQ ID NO: 5093 - protein, 313 aa, Bacillus licheniformis
MFNLIVNEWIKIFNRKGTYVMIGILLLAVIGLGVLTKTIGETDQNTDWKKELAQENKDMKEQLKGNSNPTLEKNYEQSIAINEYRIKHDLPADGDYSALSFISDTSGLISLAGLFVITVAAGIVANEFSWGTVKLLVIRPISRFKILLAKYFTVLLFALALLFILFASAGITGLALFGAGDSSQVHLVYVGGTVEEKSLLLHLAGSYLLNSISLLMMATMAFMISAVFRNSSLAVGISIFLLVMGGTVTGLLATKFAWAKYILFANTDLTQYFDGSPVVSDMTLGFSIVMLAVYFIVFHVLAFVVFTKRDIAS

SEQ ID NO: 5094 - protein, 66 aa, Bacillus licheniformis
MLEGKVKWFNSEKGFGFIEVEGQDDVFVHFSAIQGEGFKTLEEGQSVSFEIVEGNRGPQAANVTKA

SEQ ID NO: 5095 - protein, 333 aa, Bacillus licheniformis
MITFEGVEKVYESGGQKVHALNGIDLHVDKGEIYGVIGFSGAGKSTLIRCVNFLEKPTAGKVFVGGRDLMSLSKAEIRTVKRKIGMVFQHFNLLNSKTIFANVAEPLALVKTPKADIKKKVTELLRFVGLEDKARDYPDQLSGGQKQRVGIARALATNPEVLLCDEATSALDPQTTGDILKLLKRVNEQYNITILLITHEMNVAKEICDKVAVIEKGRIIESGSVFDVFSAPETETAKSFVKSAIDHEIPESIQKLNLKHLYQLQFVGESSGKPFLSQVSKRYDVEVNILHGTITELQGIPFGSMTVELQGEDGEIGRALEYIRRENIRIREV

SEQ ID NO: 5096 - protein, 216 aa, Bacillus licheniformis
MLVTYDQIIDALVQTIQMTVFSLLFSSVIGIPLGILLVVTRKGHLLENPAVFTFVNMIINIFRSVPFIILMVALIPVTRLIVGTSIGTSAAIVPLTFYAGPYIARLVENSLLEVDPGVIEAAEAMGATPRQIIFRFLIPEALGSLVLSFTVATVGLVGASAMAGAIGAGGLGDLAITYGYQRFDTLTMIITVAILVIVVQGLQTSGNVLSKKLRRR

SEQ ID NO: 5097 - protein, 272 aa, Bacillus licheniformis
MKKFACVVIFLLLAAVIAGCAADSDAKTIKIGISGTDTRIWDFVKKKAEKEGLKLEIVKYSDYVQPNQALASGDIDANAFQTISYFNAFKKERNLELSPVGTTIIAPMGIYSEKYDSPGDIPNGAEIAVPSEATNMGRALLLLESAGLLQLKDGFDGNGTLDAIKENPKKLKITTVAAEQTPRVLADVAASVINNGIAVDAGFHPVKDSIKLEDETATPYINIIAARTEDRDREDLKKIVELYQADDTAELIKKEFDGAQLPTFVPLKDIGE

SEQ ID NO: 5098 - protein, 461 aa, Bacillus licheniformis
MTLFVVINIIVMLGLMALLYMMQKKHVSFSKRVFTALGIGIVFGFALHFIYGSSSETITQTSDWFNIAGGGYVKLLQMIVMPLVFISILGAFTKLKLTHNIGKISGLIIGLLIATTAVAAAVGIASALAFDLQAVHVDQGQAETMRGAELEQKSQDMEAKTLPQQIVELLPGNPFLDFTGARPTSTIAVVIFAAFLGIAYLGVNRKQPEQAELFKKMVDAVYAIIMRVVTLILRLTPYGVLAIMTKTIATSDLDSIAKLGKFVIASYAALIVMFIIHLLLITFSGLNPVTYLKKAFPVLVFAFTSRSSAGALPLNIKTQRSLGVPEGIANFAGSFGLSIGQNGCAGIYPAMLAIMIAPTVGQNPLDPSFLFTVIAVVAISSFGVAGVGGGATFAALLVLSALNMPVALAGLLISVEPLIDMGRTALNVSGSMTSGLVTSKVTNELEKDTYQDRTNIIEAEV

SEQ ID NO: 5099 - protein, 113 aa, Bacillus licheniformis
MFRRRSGIHPAVLVLGSAALTAAFSPEIRKRLTGMFANGMRGRQQGSGRNQTMMNPADMIKQAFNPGGQSHEHRQSGHTANDQHQSSHMTAPVNVMNDQAAAQTMFDDDQSYS

SEQ ID NO: 5100 - protein, 598 aa, Bacillus licheniformis
MEKADSILHALRIKDFAVHPDETQLIFDTNLNGTSNLWAMDLPDTYPYQLSFLNQDSKGIAYNPDGSILYAGFDNDGNEQSGLYKLSLKNGTFQSLNGNQTDRHFAPIPVQNAVYYSSTKDNPTFLNTYRYDCLTEKEELIFEGKDGTSMLSDVSPGEKAVSIHVYYVNSHSVCMVHTAEGVTTGIFPDETLPHMVYSSHFASDDRLFVTTNYEAEFSYLALYTVSSGIFTPVLSIDKTDLTSIHADPNGTFLYLIGKKGVKEVMYEYNTATGQSRQIDCPCTSISKIHCAYSGTLYILGSTPTRPTNLYVLTKGQSKWRQLTKHSVPGFSEQELSYPEVVTYPSFDGLPIEGLLFKPSPVEANGWTIIWPHGGPQDAETFMFYDLFQLAAKMGYQLFAPNFRGSANYGYSFFKMVEQDWGDGPRLDMTAGIDWLIDQKLADREKLFLMGGSYGGYMSLLLHGRHPEYFRAVVDICGVSNLFSFVKTVPDFWQPMMEKWVGNPERDYEKMKADSPVTYLENMTQPMLIIQGANDPRVVKEESDQVVDQLRNMERNIEYLVLENEGHGFSKKENKMKVYRAIFEFFEKHRLYHAAKVEE

SEQ ID NO: 5101 - protein, 186 aa, Bacillus licheniformis
MFNMKKGAIAALLLPLLFTAGCGMANQGADNNRRNQDNALQNVTNRDNDATNVNDGRNVNDRMNVTDNRDANREDNNMEVADKAADKVAELKEVSSANVITTNRNAYVAVVLKGNPKGNLTNELKGKISKKVKETDNNINNVFVSANPDFVDRMRNYGDRIQNGEPIEGLFEEFGETINRIFPNQR

SEQ ID NO: 5102 - protein, 297 aa, Bacillus licheniformis
MTGEMKAAFVLIMAGALSALLLAIFVVFSQESPEAAVLSGKKEKLKESLEMVKYESVSIYYAEKDRPILELTKETLRDAADMNRELFVSPLQDSVDLIFFSNRDDMESFSKLKDITGFYSNDMRMIGLLPEERKHLNNGEGFAVFLYKRVLVHEYTHYAFHVKLRELNADPGTYPLWFHEGVAEWASAHAAIEIRTLPSVVPLSKLKTDRQWQKARTGYETDIYLQSYYLIEELAEKKGRGVILDIIEETAERGSFADGFKAAVGQSLTGFEKEFKRKYEAKKTALKFHLQCRFHDQ

SEQ ID NO: 5103 - protein, 215 aa, Bacillus licheniformis
MEQQNQPQMQINQGNEGMQHMNHGGHEVFDMHEVLSGMIGVLEQYMMFREHVKDPELLDILDRQHRFISSQYNITTECFRTGQKPSQETATYMMKEDRKFVYGLKDAQPKQPKQSVQAIDDACISSFMLGLMKTCCSSLAMAAPEVTNPVCRRVLADQIPHYIEMAYEIFLYQNKHGYYQVPQLAPQDMQKMTSAFAPVQGQPQMPPSGQQRPIH

SEQ ID NO: 5104 - protein, 674 aa, Bacillus licheniformis
MLGSSETVGKKSGLFGNDSVYPKVQTEVYKKINELSGFHRLDDIYLSLIDKYMFPCLILNDRGEIVASSESADQYLKSSKGSIHQVFPASLSVQVNAALQRAKKEKKEVSFKNVPIYLSGELSFVHLRLKCFFRQYHKLYVLFIEKAQEGAANAPVSGGEDGQLHLQHLYRTVKELEASNDALVSANQKLQEENRKLTALNRAFEKKVNELNTLKNDMNNLLTSTNIAAVFLDQELKLKLFTPEAANMFDLKNEDLSRPADKLTERFKYEGYADDLRRTLYENKTVVKEFEMPDGGWYAVKMIPYYTSGNMVEGIVVTFTNVTELKMTNEALHISSQAIDQSPANILITSVDGSVTYANKRFCRMFGKHQDDIIGGNVFDIYRKHFHCEDLTRFWKRVLEKKPWSGELNYQDEEQQDRWEQISLVPVEDSAGNVQQVMLISEDITNQKRSEKMLMKSEMLSAVGQLAAGIAHEIRNPLTSLKGFLQLMIQSKKYQKDYAEVMMSEFIRLEAIINEFLVLAKTKSNTFDPVQVNSIVEDVCMVLESQAVLNNVRIEKQLSGDLPEILAVSNELKQVFINILKNAIEAMEDAEGFITIRSYFEKDSVFITFEDQGKGISKEVLEKLGEPFYTTKEKGTGLGLMVTFKIIENHGGSIHFESEEGKGTIVKLKLPIKE

SEQ ID NO: 5105 - protein, 1206 aa, Bacillus licheniformis
MVNVVKSRFMAGLTITFMMIASFLTPFADVTHASETISVEEAIKHNEGHAAVEGYVVGHTISSGHYRFSGNFANDYNVAIADKKEETSPENILPVQIPAPFRDQFGLKTNPHLIGKKLIIEGERTTYFNSPGLKSVQSITFSGDDAPSAQPETKTIAEARKLLNETVKIKGIVTADQAAVGGGKLSTFIQDDTAGINIYSAAQGDFPELKEGMSVSVTGKITTYKGLTEIVPAPSGIEVTGEGAALPDPVPLTIKDVLDQGTAAEYEGRLVRMKGFIETKPDAPAGGGYNITMIDENYHPLTLRVMEQTNAAASIEQGQWYEITGILSRYDSVQLLPRKQEDLRKLDGAAHPPPAAEGEYESVVERVVDGDTIHLKEPVLGSTKVRYVNIDTAETYHKPKNELDENQLQHGNKAKEYLQSILAPGDKVTVKVGKEAKDSYGRLLAQVITEDGVNTNLQLVQKGMAVTYFIWPVGSDEDYQLFQNAVKKAKGDKIGIWNPADPLLEMPFEFRDREQGKGLTRHVGDSAENTYVAPEKWREIPVERRIFFASAEEAEAAGYSKKEQSGNIPLRLLSMNDLHGKIDQQYQLDLNGDGRTDGTFGRMDYAASLIKEKKAEQENTLIVHAGDMIGGSSPVSSLLQDEPTVEVMEEIGFDVGTVGNHEFDEGTEELLRMLNGGEHPEGKGTKGYDGQDFPLVCANCKLKASGDSFLPPYEIIEVEGVPVAFIGVVTQAAANMVMPEGIRSIEFTDEAKAVNQAAKELRAKGIRAIAVLAHMTASQDGGVVTGESAELAKKADPEIDVIFAGHNHEVVNGQVNDILIVQAYEYGKAIGVVDLEIDRETKDIVHKKAEIEYVNQENLKPDPAVGQILDKYERMVAPIISEKVGEAAHDMAGGYSNDGDTPLGNLIADGMRQAMNSDFALMNGGGIRQDLKKGTITWGDLFNIQPFGNVLVRLEIKGRDLYDIIDAQISPSYGPDYSISGFAYTWDPKTNKTAAIFLEDGTPIDLDQTYTLTVNNFMASASGSKYLPISRLGKNPVTGPEDIEATVKFVKSFKEPIAYTAEGRIKKLAEDDSRPGEQPGRGADPDDKEKPGSGGADPNDEEKPSGDKGDGGKPGNDTGESPVHDGTGNASRSGAIPVAGMTTGEGSDAPAEKMDGLSNDAFLPDEREERKLPDTAAAYGGFLLYGFLTFMFGAILYMRKRGIARL

SEQ ID NO: 5106 - protein, 196 aa, Bacillus licheniformis
MKVKMLSFLLMIAGLATFAYGGWKIFDMNRQTDLSLTEAKEAIASSQSARSAKHPSAPASFKPAAGEAAGILHIPKLGAELPIVEGTSPDDLEKGVGHYKGSYYPKQNGQIVLSGHRDTVFRRTGELEIGDKLKIELPYGSFEYEITHTKIVDQSDTSIITLQREKEELLLTTCYPFSYIGNAPERYIIYAKPLKG

SEQ ID NO: 5107 - protein, 305 aa, Bacillus licheniformis
MNQKNHGLFFSADIRHHGELLYAYLKREAKASKPVIQYWIANEKVKVNHKSVNHNVRLESGDSVMIDLREEEESGIVPEYGELPVLFEDDHMLIVNKPAGMATHPNEAGQTGTLSNLVAFYFQMNGEERKVRHVHRLDKDTSGAVVFAKHRLAHALLDEQLQRKELARTYVAVAEGKFRKKTGTISAPIGRDKHHPVRRRVSHSGQPAVTHFESKGYDSRHDVTLCRLQLETGRTHQIRVHLASIGHPLSGDTLYGGSKGLFQRQALHAIEINVTHPITKERVTVAAPLPDDLKDEIGRLFGTVD

SEQ ID NO: 5108 - protein, 119 aa, Bacillus licheniformis
MRIVKAATEEQEIYIEELVSELYQIFPLYLNKQKIKELKKQGALQLKEDEYKGTLDEAFQIMTSLQLIHALLTKAKRKWVLKDRDLFDKNSRKLNDCGLYFPLTSADFHIVNTENKMLM

SEQ ID NO: 5109 - protein, 141 aa, Bacillus licheniformis
MTTISNAMSRQVATISSNQTVQEAAELMSRHNVGAIPVVDQGVLKGMITDRDITLRTTAEGQDGQTPVSNVMTTNVVSGNPNMSLEEASQLMAQSQIRRLPIVENNHLVGILALGDLAVNELSNESAGQALANISTPARTQ

SEQ ID NO: 5110 - protein, 220 aa, Bacillus licheniformis
MIKAVIFDFDGLILDTETHEYEVLQEIFEEHGSELPMSVWGNVIGTAAGFQPFSYLEEQLQKKLDHEQLTKLRQERFTKRMENEKARPGVEAYLSAAKELGLKIGLASSSDYKWVSQHLKQIGLYDDFECIRTADDVEEVKPNPELYLKAAECLGVKPEECIAFEDSVNGSIAAKRAGMKCVIVPNKVTKSLLFEHYDHRLESMAEMELEQLIEKISDPS

SEQ ID NO: 5111 - protein, 512 aa, Bacillus licheniformis
MSEKLDLSRFEKKIVIRNIEEKDIDSIIGLQELCFPGMIPWKREHLESHLEHFPEGQFCAELDGEVIGSCSSLLINFDEYDDRHTWQDITDDGYITNHNPDGLNMYGIEVMVHPEYRRMKIGHRLYEARKDLARRLNLKSIIIGGRIPNYHKYASEMTPREYVEQVIHHQIYDPVLSFQLLNGFTMMRINPNYLPDDRASSKYATLMEWNNVDYLPQTKRYYKSAFPVRICVIQYEMKQIHSFEEFANQVEYYADVASDAGADFAVYPEIFTTQLMSFLEERSPSLAVQRITEYTEDYISLFTDLAVKYNVNIIGGSHFVEEEGKIYNIAYLFRRDGTIEKQYKLHITPNERKWWGISRGDEVRVFDTDCGKIAIQICYDIEFPELGRIATEKGAKIIFTPFCTEDRQGYLRVRYCAQARAVENQVYTVISGTVGNLPQTENMDIQYAQSAIFAPSDFEFARDGIVGECNPNIEMVVIGDVDLEILRRQRQDGTVRQLKDRRHDIYRIHYKK

SEQ ID NO: 5112 - protein, 542 aa, Bacillus licheniformis
MIICSLQHVGQTYGGHTIFNGLSWDLHQGERVGLIGRNGEGKTTLLKLISGQMKPDEGLVTWKKGLSTGLLEQNPAWDGSKTVKELLYDVFSSLWNTQQKLSRIERQLAVEKDAEKLRFLLEKYGALQDEFQRKGGYGISAQIERVAHGLNIERLFDAEWRELSGGERTKAGLARLLLSAPDLLLLDEPTNHLDLTSIEWLTSFLKQYKGTAVIVSHDRYFLDESVTSILEIDQGELHFSKGGYTHYADEREERLMREFHDYQDQQKKIKKMKETIKRLKEWANRANPPNDGLHRRAKSMEKALERMEKVKKPVLERKKIDLVFSMDERSGKDVVRLEDVCKSFGERQLFDNLSMHVRFQERAAIVGENGSGKTTLLNIISGKETPDSGDVQLGSNLSAAYLTQHVGEMEEERTVLAEFREHVSASEGEARMMLAKFLFFGQSVFRKVKDLSGGERMRLRLAQLVHQNHNVLILDEPTNHLDIESKEMLEEALSQFQGTIIAVSHDRYFLDRLFNVIWWLDGRKLVKYEGNYTFAREKRQQG

SEQ ID NO: 5113 - protein, 266 aa, Bacillus licheniformis
MAFRKPDEIANAAIEAGMKKVQLPLPSLLVLGFLGGAFIALGYLLDIRVIGDLPKEWGSLSSLIGAAVFPVGLILVVLAGAELITGNMMSVAMALFSRKISLKQLAVNWGIVTIMNLIGALFVAYFFGHLVGLTETGPYLEKTIAVAQGKLDMSFGKVLISGIGCNWLVCLAVWLSFGAQDGAGKILGIWFPIMAFVAIGFQHVVANMFVIPAAIFAGSFTWGQFIGNIIPAFIGNVIGGAVFVGLIYFIAYPKKDRSRKEMKQVS

SEQ ID NO: 5114 - protein, 303 aa, Bacillus licheniformis
MEFLFVLLPVFGIFAIGFIGQKLLHFDIQNLSKMSLYLMSPFLAFDTFYENKLTMDYIYMSVYCLGLCLTLILFVYLISYVHGYSNQERCALVLSSAFMNNGNYGTPVVLLVYGTAGLDIAVVLMVLQQLVMSTIGMYYAAKGSPEAGGFKIVMTRVIRMPVAYGALLGICFQLGHISIPEQLMTGIKLVGDAAIPTIMIILGMQLAVISFQHIEYRKISYSLLLKLFVSPLIALGFALILPVDGLVKQIMVLAAAMPTAANTTLMAVQFETKPEIVSSATFISTMLSIATLPVVLWLLSLWG

SEQ ID NO: 5115 - protein, 330 aa, Bacillus licheniformis
MKAIIHEGIKGLSGLKYTDVSDKTPGPGEVKIRLKAAGLNHRDLFLFQSRKAGDAPFIPGSDGAGMIEETGEGVRDLAVHTEVIINPSIGWEYTDSVPQVPDILGGPSDGTFAEHVIVPAKHVLKKPAHLSWEEAGVLPLSALTAYRALFTKGHLEKGEHILIPGAGGGVATNALLMAKAAGARVIVTSRSEEKRKEALRYGADFAIDSRGLWKESLDGERVDLILDSIGPATFANYFDVIKPNGRIVIFGASSGESIQLPLRSLFFPQISIIGTSMGSLEEFRQMIDFIERHSLKPVIDQVFPLSEAVPAFKRMKDGEQFGNIALQIDG

SEQ ID NO: 5116 - protein, 185 aa, Bacillus licheniformis
MSFHDQNILPAVRNMKQFDTFLDSPFSYGVLLDIHLGQLGGVISAARSHGKKMFVHVDLIQGIKHDEYGAEFICQEMKPAGILSTRSSVIAKAKQKKVYAIQRMFLIDTSAMKKSIELVKKHRPDYIEVLPGVVPELIREVKEITGIPIFAGGFIRTEKDVEQALAAGASAVTTSDTDLWKKYWN

SEQ ID NO: 5117 - protein, 271 aa, Bacillus licheniformis
MTAFWGEVIGTMLLIVFGAGVCAGVNLKKSLSHQSGWIVIVFGWGLGVAMAVYAVGGISGAHLNPAVTLGLAFVGDFPWEEVPSYILGQMIGAFLGAVLVFLHYLPHWKETEDQGAKLGVFSTGPAIPNTFANLFSETLGTFILVLGLLTIGANKFTDGLNPLVVGFLIVAIGISLGGTTGYAINPARDLGPRIAHFVLPIAGKGSSNWKYAWIPVLGPALGGSFAGVFYNAVFKGHITNTFWIVSVILVVILLGFYIHMKKQAVDQSVNI

SEQ ID NO: 5118 - protein, 496 aa, Bacillus licheniformis
MEKYILSLDQGTTSTRAIVFNKAGEIVHIAQKEFRQYFPNPGWVEHNANEIWGSVLSVIASALSESGIEAGQIAGIGITNQRETTVVWDKHTGKPVYNAIVWQSRQSAEICQELKEKGYEETIREKTGLLIDPYFSGTKVKWILDHVEGAREKAENGDLLFGTIDSWLIWKMSGGKAHVTDYSNASRTLMFNIYDLKWDDELLDILGVPKSMLPEVKPSSHVYAETVDYHFFGKNIPIAGAAGDQQAALFGQACFEEGMVKNTYGTGCFMLMNTGEKAIKSEHGLLTTIAWGIDGKVEYALEGSVFVAGSAIQWLRDGLRMFKDAKESEKYAVRAESADGVYVVPAFVGLGTPYWDSDVRGAVFGLTRGTTKEHFIRATLEALAYQTKDVLDAMKEDSGIPVKTLRVDGGAVKNNFLMDFQGDILDVPVERPEINETTALGSAYLAGLAVGFWSDRSEIKDQWQLDKRFEPKMEEKERESLYNGWKKAVNAARAFK

SEQ ID NO: 5119 - protein, 555 aa, Bacillus licheniformis
MESLFSSRKRDDILQNMTKQKYDVFIIGGGITGAGTALDAASRGMKTALCEMQDFAAGTSSRSTKLVHGGLRYLKQFEVKMVAEVGKERAIVYENGPHVTTPEWMLLPMHKGGTFGKFSTSIGLRVYDFLAGVKKAERRSMLTAEETLQKEPLVKKNGLKGGGYYVEYRTDDARLTIEVMKEAVKFGAEAVNYAKVSDFIYENGKVTGVVIEDVFTKKTYRVYAKKIVNAAGPWVDRLREKDHSKEGKHLQHTKGVHLVFDQSVFPLKQAVYFDTPDGRMVFAIPRDGKAYVGTTDTVYNENLEHPRMTTADRDYVINAINYMFPELGIKAEDVESSWAGLRPLIHEEGKDPSEISRKDEIWTSESGLITIAGGKLTGYRKMAEHIVDLVRDRLKEEGDRDFGPCRTKTMPISGGHIGGSKNLEAFIQAKAAEGIEAGLSEETAKQIAARYGSNADRLFDRIPSLKDEAAKRRIPVHVLAEMDYGIEEEMAAVPADFFVRRTGALFFDINWVRTYKESLTDYMSEKLNWDGETKARHVKALEGLLHDAVVPLESK

SEQ ID NO: 5120 - protein, 582 aa, Bacillus licheniformis
MSWRTSYERWRNKENLDSELKALLLEAEGNEKELEDCFYKKLEFGTAGMRGEIGPGPNRMNVYTVRKASAGLAAYIGANGGEAKKRGVVIAYDSRHKSPEFAMEAAKTLAENGVQTYVFDELRPTPELSFAVRELNAFAGIVITASHNPPEYNGYKVYGEDGAQLPPADADKLTGYVNAIENELEIEAGDEAALTEKGLIKIIGEEIDQAYLDKLTSISVNPDLAKETEVKVIFTPLHGTANKSVRRGLKALGYEHVTVVPEQELPDPDFSTVSSPNPEEHAAFEYAIRLGEENGADILIGTDPDADRLGVAVKDQEGRYVVLTGNQTGALLLHYLLSQKQQKGMLPDNGVVLKTIVTSEMGRDIAASFGLDTIDTLTGFKFIGEKIKQFEASGEYAFQFGYEESYGYLIGDFARDKDAVQAALLAVEVCAFYKKQGKSLYDGLLELYKSFGFYREGLKSLTLKGKEGAEQIAAILSTFREQPPLSIAGKDVVSAEDYLTGKRTLLKENKRETIDLPKSNVLKYFLEDGSWFCLRPSGTEPKVKFYFAVKGRTNEESEALLNQLTDEVMKKIDDIVKATSNS

SEQ ID NO: 5121 - protein, 152 aa, Bacillus licheniformis
MKWIKIGDEYIEKKMTQFFSEAGTIVAAILCLDMIIRGFILGKPASEYIISAIGFAVYAGWILLRYLLSGFEYPEIAGQSAYRKKRKEIAALSLASGLIFAILTLLFTGIPEHPGSWVDFIGMVMLFAFLHFLINFISLRNSFRKNQDLLDD

SEQ ID NO: 5122 - protein, 65 aa, Bacillus licheniformis
MVNRVKLARIEKSLTQAQLAERVNVTRQTIGLIEKNKYNPTLQLCIAIAKALDKTLDDLFWEEKA

SEQ ID NO: 5123 - protein, 385 aa, Bacillus licheniformis
MKLLREDTQFEKLKTLKEIAETLNEGNDLKETLHAVLKKLLRLTGLKTAWLFLIDEKGSFELAASARLPQALSYRQNRLLCEGSCYCLEQYRDEKLDRAKNIIHCRRITTAMKQKTGDPEGITHHATVPLSDQKKRFGLLNVAAPGKIHFSRGELALLEAVALQIGMAIKRMRLAEQQQKHLLLTERNRLAQDLHDSVNQMLFSLSLTAKAAGEMTDQPEIREMLEFMQNLSHEALLEMRALIWQLRPQGLEEGLAAALEKYAEVLGLQVIFKLSDVLRLPPSVEELMWRLSQEALNNCKKHAGASRIQVKINVFQSSAVLEIEDDGKGFQYDPNVDIPTLGLKGMKERTEKAGGTLLITSAIGKGTKIRAVLPMKEKGEAGWRR

SEQ ID NO: 5124 - protein, 217 aa, Bacillus licheniformis
MEKVKIIIADDHHIVRKGLLFFFKTKSDFDVIGEASTGIEALDVLRKREADIVLMDLSMPDMDGIEATKRIKKEYPSVKVIALTSYADESYVIPAIQAGACAYQLKDAEPDELVETIRAVYGGRYSLDPNIMSHVFHHVSQADEKEKIHQLTNREKDVLLEITKGKSNKEIAASLFISEKTVKTHVSNLLSKLGLSDRTQAALFAVKHGLQQNDGRG

SEQ ID NO: 5125 - protein, 179 aa, Bacillus licheniformis
MTGEDDQMKITVISGTARKQGRTRIAASYIARAYQAELIDLSEFILPIFNGDEEQSSLENVQKLKASVKEADAVVLLSPEYHSGMSGALKNALDFLSNEQFSGKPVALFACAGGGKGGMNALANMRIVARGVYANVITKQLVLDPIHIDEEHQTVTEAAKANIKNVMEELLLFAEFQKA

SEQ ID NO: 5126 - protein, 85 aa, Bacillus licheniformis
MAKLNYADYDKALYYTHRSQWDNLLILMVRTEDDLLSKRIEHFLHAYNFERDDAIVEKRLYDLLQYIDHASFSGHEHENGVLVFT

SEQ ID NO: 5127 - protein, 106 aa, Bacillus licheniformis
MKKRYCTYFFCILTLLSFPAKGHFQTDVFDAPERWERIAWSALEEKYKGAKLEDYEYLGRTQVNDEETKDVFRVTVNQEGKSFSAHAEVYFHPVTNAIINVNIFPL

SEQ ID NO: 5128 - protein, 143 aa, Bacillus licheniformis
MKLTNYTDYSLRVLIFLATKNSNELVNIKDIADSYSISKNHLMKVIYELGKLGYVETIRGRNGGIRLGKAPELINIGEVIRHTEDDFNLVECFNGEKNHCILSPICGLKHVLNKALSAYLDVLDQYTLQDIIMNQDHIRKLLS

SEQ ID NO: 5129 - protein, 404 aa, Bacillus licheniformis
MLSEKTMQIVKSTAPVLKEKGTEITTCFYKRMFDAHPELKNIFNMSRQQTGGQPKALAFTVLQAAENIDRLEDLLPVVKQIGHKHKSLHVKPEHYPIVGQHLLEAIEIVLGEAATEDILQAWAEAYEEIARVFIEVEKQMYEEDKKQDGNWEGFKPFVIMDKRVESDTITSFYLKPADGTALPAFSPGQYVSVCIKIPGEPYFLTRQYSLSDAWNKDYYRISVKLEAEEGQPVGKVSSYLHENMEIGGSLEVSAPAGDFTLSEGTDRPVYFISAGSGITPVMSMVQTLAQKESRREITFVHAAKTERHHAFKEETEKLLGANPANRLLFVYSRGAEATEEHTVKGRVNEELLKSVVIDPNGEFYVCGPLSFMKSVIEGLQNLGVSMENIRYESFASSLDMQIAN

SEQ ID NO: 5130 - protein, 469 aa, Bacillus licheniformis
MSIREQKELQRAIEEITEIAEGFGLDFYPMRYEICPAEIIYTFGAYGMPTRYSHWSFGKQFHKMKLHYDFGLSKIYELVINSDPCYAFLLDSNSLIQNKLIVAHVLAHCDFFKNNCRFQNTKRDMVESMSATAERIKHYETVHGSKEVEAFLDAVLAIEEHIDPSLVRPKLSWSVDDEEEEETGAPATPYDDLWELDHKGSKEKKKRTKKKFPPKPEKDILLFIEEHSRELEPWQRDILTMMREEMLYFWPQLETKIMNEGWASYWHQRIIRELDLTSSEAIEFAKLNAGVVQPSKTGINPYYLGLKIFEDIEERYNNPTEDMKKMGVEPNSGREKIFEVREIESDISFIRNYLTKDLVMREDLYLFQKQGRDYKIVDKDWEAVRDQLVSMRVNGGFPYLTVEDGDYLKNNELYIKHWYEGIELDLKYLEKVLPYLHQLWGRSVHVETVLEDKPVMFSYDGKAVHRRYL

SEQ ID NO: 5131 - protein, 277 aa, Bacillus licheniformis
MKKQVITAASAVVLGSTLFAGAASAQTITVKKGDTLWGFSKKYGTTVSKIKQENKLKSDIIYIGQRLSINGSSSSSAKASKVSSATHKVVKGDSLWKISRTYGMTVNELKTLNGLKTDLIRIGQVLKVKGTKSVKAASTTKPSASSGTSKTSAPAQKSSTLNTSKLVSDAKALIGTPYKWGGTSTSGFDCSGFVWYILNKQTNVARTNTVGYWNSMKSVSSPAVGDFVFFTTYQPGPSHMGVYIGNNQFVHAGSDGVTISDMTNSYWKPRYLGAKRF

SEQ ID NO: 5132 - protein, 143 aa, Bacillus licheniformis
MQSSNLNCYSMYSDPVILVAPHDGRAAEQAPPLDVEDLLEEYLLLTHNHPEYWDDLVRQLRIKFPFVRTMLVSQAHITKRFISEGLGISFLPLSTVRRELMEGRLIEVPCDFMKLPVAGGYAISLKDNEKVEHFLAFLAEFRF

SEQ ID NO: 5133 - protein, 284 aa, Bacillus licheniformis
MIRSLPAELDDMAVLRTAVSSFGDISFAFKPTMEQALRLIAAVPSIIAFRKRLADGEEPVQPLDELGFVENYFYMLKGKRPTEAQKKALETYMILAMEHGMNASTFSARVTVSTESDLVSAVTSALGTMKGPLHGGVPSAVTDMLEGIGEKQHAESYIREKLEKGERLMGFGHRVYKTHDPRAKALRVKAEEIAGGDRDIDLALHVENTAIRLLEEYKPGRKLYTNVEFYAAAVMKAIDFDAALFTPTFSAARMVGWCAHVLEQADNNMIFRPSAKYVGELVSQ

SEQ ID NO: 5134 - protein, 354 aa, Bacillus licheniformis
MKKGFLMLIMLFFLGACTEGRDFDAEYEATSAKEGGSGAEVIADRLDVPWTIAHTGETFYITERNGGIVSIADGKKERMQLQLKKPVHQEGEGGLLGFVLHPDFRNSQEAYVYHTYKDGSHLKNRIVKLTLDRLTWTETDELLADLPGGAIHNGGRMAIGPDQKLYITTGDAGEREWAQQPEKMAGVILRMELDGTIPADQPFSSSYVYSFGHRNPQGLAWIGRQLYSSEHGQSGHDEVNKIEPGANYGWPVIEESDEKQGMKAPLIHSGEKTRAPSGLAQKGDVLYMAGLRGEGVFQVDPAEAKVVKWLGGYGRIRDVKVIGDDLYFITNNGDGRGEKKQTDDRLIRVPLPDK

SEQ ID NO: 5135 - protein, 289 aa, Bacillus licheniformis
MNPANRQTDGQKAQKQEKQPGAEHKMVPLPLSEDRDYKGSGKLKGKTAIITGGDSGIGRAAAIAYAKEGADIAVMYLDEHKDAEETKERIEQEGAECLLIPGDVGDEAHCKSSVEKTVNHFGGLDILVNNAAEQHPQKGIEDISTEQLERTFRTNIFSMFHMTKAALPHLGEGSAIINTASITAYEGSPALIDYSSTKGAIVAFTRSMAASLVKKGIRVNAVAPGPIWTPLIPATFPPEKTEKHGTDTPMGRPGQPSEHAAVYVLLASDDSSYMTGQTIHINGGRYVTT

SEQ ID NO: 5136 - protein, 452 aa, Bacillus licheniformis
MSDRRMTAKWASKLGFVLAAAGSAIGLGAIWKFPYVAGTSGGGAFFLVFVLFTILLGYPLLLGEFVLGRKSQSDAIGTYQKIAPGTPWVITGWIGIAACFLVLSFYSVIGGWILLYIIKAVTGSLSGLTQAGYGELFGSIIQDPLQTLAAQLAFIIMTILVVAKGVQKGIERVSSIMMPLLFILFIALVLRALTLEHAIDGVRFLLVPDFGSLTPQAILFALGQAFFTLTLGVSVMVTYSSYLSKSQNLPKSALSIVIMNLAVTLLAGLAIFPAVFSFGLQPDQGPTLLFAVLPAVFDRLPFGMLFFIGFLTAFLFAALTSAFSMIEIIVAAITKGDQTKRGKWTWTIGLLIFAVGIPSCLSYGMLDEPFIFKKTFFDAADYVVSNILMPLGALFISIFIPLKLSKHDLYEEMKSGSKAGKGFFIVWFYLLRFLVPLAIVLVFLNLIGVFSF

SEQ ID NO: 5137 - protein, 542 aa, Bacillus licheniformis
MVLDFQQMFPSEDGNHEARYQLLALLEAVLAGMDRLKDPGRLTLGRESEVSSDYYQSVIEEAVLPEKGFGAEKSVEELLKLLDGHRFLNRHYVANATPLPNNASIAGNLLMVLLNGNNLWDVDGTAAARTEVQITAMLSDIVGYDRHKSGGFTTWGGQGAVFQSLRLAIANAYPEANQQGTPHHLYAFCSELSHFSLYKSMEASGIGTDHLIKVKTNHDHSMDLADLREKMQAVIEKGGHPIYVLATLGTTDAFGIDDLAGIKNVTEEIEAAYGLPPVYIHADTAMGGMYSFFNGYDFSGNPLHIEDEVLETLARYKQHFQHLHLADSLVFDFHKLGQTPYITSLFLVKNRKALQAVDLDPDETPYVGNRGFGSYHTSYTLECSRMGSSIPIYASLLAFGIEGYQEILANYIRVNLAFRKKLLQAFPNAAVTNDVSPVTTFRFYPGNVRYHEEISGAITEEEVRNINKYNEKIAETLGRYRSHTYFGSTKKQTYVYPADSRLPVPLYVQKFYSVSPYTTVDTTDQYIAFLKAHVETSDVAAG

SEQ ID NO: 5138 - protein, 295 aa, Bacillus licheniformis
MDLLKNMNQAMAYIEEHLTDSIDFQTVAKLSYCSEYHFKRMFSFLAGVSLSEYIRRRRLTLAAFELKNTKRKVIDIAVKYGYHSPDAFTRAFQKLHGITPTEARHDISTLKAYPPMTFQLTIRGGNEMNYRIVEKKAFRIVGIKKRVPVVFHGINPDIASMWKTLSSENIDELKELSNVEPLGLIQASANFSEGRMEEQGELDHYIGTATTKECPDQYEQLEVPASTWAVFEAAGPFPDTLQNVWGRIYAEWFPSSHYEQTKGPEILWNQDQDISSPTFKSEIWIPVQKRTACKN

SEQ ID NO: 5139 - protein, 470 aa, Bacillus licheniformis
MDITPFLNRSGSEPLYQQLYTFFKRSIHSGHIKPGTKLPSKRMLSKHLNVSLTTVEHAYEQLAAEGYLLSKPRKGWFAAEAEGDFAQTAPPPPAEKELEEHETAANMIDFHHGHVDLASFPVSQWKKTLAKTVGESGYDLFQSGPPAGDIPLRKMIAVYLRESRGVVCSPEQIIIGAGTPVLLQLLCHLFPKGTTVGFENPGFHRSKTVLKTGGFNVVPIPVDESGISVQDLEQYQPQLAYTTPSHQFPLGMIMPVGRRLQLLDWAAATGAYIIEDDYDGEFRYAGQPIPSLQGLDRNDRVIYLGTFSKSLIPSLRISYMVLPFPLVKEGLNMASLFKQTVSRHVQHAIALFMKNGDYQRHLNRMRTLYRKKRKTLLDAIKREFGGHAAVRGENAGLHIILEVKSAPSEEWLTQKALEKGVKVYPASVSYMPPPDTHAVLLGFGGLSEKSIADGIKKLKTAWFNGGQSQD

SEQ ID NO: 5140 - protein, 144 aa, Bacillus licheniformis
MLLDYRELHCETELKEVYPIMKQLRPHLDETSFLELVKEAREAESYTLFALYDGDIPVALAGFLPRVSLNQGRHVWVADLVTCEKHRSKGYGKKLLGAVEEWAKGNGLASIALSSGLQRADAHRFYEEKMGYEKASYLFRKALK

SEQ ID NO: 5141 - protein, 96 aa, Bacillus licheniformis
MELVRIFKEHNVFGWVSVGTAILSLFVLNLAILSDTIAYSYKMLPFAMAAVPLGIIELFIKKGRTGLGFLGVVLNIFILVCVWTIVSIDTNLQLGF

SEQ ID NO: 5142 - protein, 356 aa, Bacillus licheniformis
MNEDFKKRWEKYKNGELSESEMLRVEEELEQLEEYQDMLEQEMKDEDWDLAISPEKQKAILRYGKNKSYMRISTLAVISTLIILPICTLGSYLYYGLGGHESKGNELVQTASMTVAVTNPNIQVDTEALVNKVKLFGIETQFPLKKQIGNVTKVVGNEEVEMFFDQLKSPQIHQYNQELSKEERHFVYPDGIKEKSVSKAESILKQLPDGTVTEAFLSFEKAYPTKELYEKLKGYDVRVLWNAIETEGDLKDHPYAEPIGFPGKDSNRIFEIQQPAENDDEQFKAALSYMIKNKKWAETISGRKDLKLSKRLDYVEQNGVNVYGAVITGPSKEVERLIKKGPVKAAKVGEVELWNW

SEQ ID NO: 5143 - protein, 163 aa, Bacillus licheniformis
MTIDEIYQMYMNDVYRFLLSMTKDKHLAEDLLQETFMRAYIHIHSYDHSKVKPWLFQVARNAFIDYVRKHKKEVTISDDMIGNLFQNAVQSPAHQVEIKEVLTLYMNQLPDNYREALTLYYLKELNYKEASSLMNISEANFKSVLFRARQRLKALYNRGVNDE

SEQ ID NO: 5144 - protein, 180 aa, Bacillus licheniformis
MHPYQFPYHLPSPYSAGRFHGSGYAGAFRTPGTEERIVLRDYGQKPFASNINEAAKQNKTFRTALWTGRHLQVTLMSLNPGEDIGLEMHPHVDQFLRVELGRGIVQMGPSKHHLPFRRNVYDDTAIVVPAGTWHNLTNTGNTPLKLYSIYAPPNHPFGTVHRTKADALAAEGHRAHDRYF

SEQ ID NO: 5145 - protein, 199 aa, Bacillus licheniformis
MYQFTGYAAKAILSLRGGIKVYNKENLPKDTGFVIACTHAGWVDVVALGVGILPMEIHYMAKKELFENKLSGSFLSSINAFPVDRENPGPSSIKTPIKLLKEGKIVGIFPSGTRSSEDVPLKRGAVTIAQMGKAPLVPAAYSGPSNGKELFKRGKMKLIIGEPLNQEDFAQYSSKEKLVKMTEALNDSIKALEKKLEQL

SEQ ID NO: 5146 - protein, 121 aa, Bacillus licheniformis
MKWYLKAIKNYAGFTGRARRKEFWLFCLFSYMVLVIYGFFKAILHLPEYEIETFLGMVYLLANLVPGLAVTIRRLHDTGKSGFWIFIGLIPLIGKIILLIMLCQDSEKGENQYGPNPKTAL

SEQ ID NO: 5147 - protein, 425 aa, Bacillus licheniformis
MITLQPVLHIPAVSKWDEKINLKISGLQPFDTIDIIVTVKDEADAEWRSHAVFQANRLGEVDPAAAAPLKGTYQSKDQMGLFWSMQAVESSCSFYKKSVHPSAYRIEVKQKERIILSKEIKRVLLSETVDRLEVNEDGLCGTFFRPLAVNRPPAIIILGGSDGGLDETMAGMLANYGYATLAIPYFQYKQLPKKLVEIPLEYFQKAIDWLGRQEGLHHRQIGICGRSKGGELALLIGSHFPEIRFVVSHVGGGVVFQGVGLKKFRQTSSWSLNGAPLAFAPLPMFSLPQLWNMMKHKLTRQPHAFLDLYQKALRKVKDDHPAIIKAELIKGPILLTSSTDDLVWPSASMNEKIEERLKKNRFSYSVKHLYFEKAGHNIRPPYFPTSGRKSRKIAYGGKTEYDAIAAQTFWQELLLFLEKATAPGN

SEQ ID NO: 5148 - protein, 198 aa, Bacillus licheniformis
MSAQSTRDRLIQAALALFKEKGYQAASTREIAQKAGVNHLTLFRHFGNKQNLFRESVIQHVSSGDFIGELEGILSGDLRQDLSFIAKAYLKENLEKGTVFLLYFNDAVQDKEVCELIMDIPRRLNRFLEAYFAKLYAEKKISDGNFQMLSQMFFGLLNQYIMFQHLPGFKESFNDRIDDYVEECVDLFYTKLEKEVPS

SEQ ID NO: 5149 - protein, 435 aa, Bacillus licheniformis
MIFVAVLIALTAFFVASEFAIIRIRSSRVDQLIAEGNKTAISVKKVITHLDEYLSACQLGITLTALGLGWLGEPTVARLLEPLFVKWSIPSSVSHIVSVVIAFSLITFLHVVVGELAPKTLAIQKAEAVSFLFAKPLIWFYRIMFPFIWALNGSARLLTKAFGLEAVSENEMAHSEEELRIILSESYKSGEINQSEFKYVNKIFEFDDRLAKEIMIPRTEVVSFPNDMKIAEMIDITKAEGYTRYPVEDGDKDNIVGVINVKEILTACISGECSKEDTIEQFINPIIHVIETVPIHDLLLKMQKERVHMAILSDEYGGTAGLVTVEDIIEEIVGEIRDEFDIDEINEIRKIGENHYILDGKVLVNQVNDLLGIQLDNEEIDTIGGWFLTQKYDVQKGDMITEQGFEFTINEIDGHHVSYVEVKKAAETPLLEEAE

SEQ ID NO: 5150 - protein, 141 aa, Bacillus licheniformis
MRRDADGAEKYRIGELAAAAGVTKRTVDYYTNLGLLTPDRSCSNYRYYDEAALKRLKFIMDCKQQRLALSDIKERLENQFPSSTVNDDEIGSLTTEIDHVNDNISVIINRLKRLNPDERKILKSRLSPEKMTVIQSFLLLL

SEQ ID NO: 5151 - protein, 438 aa, Bacillus licheniformis
MDDIVSLIIIGILIALTAFFVASEFAIVRVRSSRIDQLIAEGNKKAVRAKQVVSDLDEYLSACQLGITITALGLGWMGEPTVKKVLHPVFESLHVSGAVSHALSVAIAFLVITFLNVVVGELAPKTIAIQKAEQMTLWLAGPLHFFNVVMFPFIWTLNASARVLTGLFGLKPASEKDESHSEEELRILLSESYKSGEINPSEYRYVNKIFEFDNRIAKEIMVPRTEIASVPLDMPIDEAISVMLQEKYTRWPVYKGDKDHVIGMINTKQLFTDMLMMSEAEKKLLSLEAYVRPVIEVIETVPVQKLLIKMQRERIHMAILTDEYGGTSGLVTAEDILEEIVGEIRDEFDEDEKPLIEKVSDHEYIMDGKVRIDQVNELFEDDIEEEEVETVGGLVLKENIDIAEGQAVHIGSYTITVLEMEGRLIKHVEVKREQTQNM

SEQ ID NO: 5152 - protein, 133 aa, Bacillus licheniformis
MLWYEIISEEERKTYIKRIEFHLRNWKNYKAAVLNLERRMEKEQKNGLAVKERNAEYRIDAEKRLYQFLLDSMETAVSELDELERKLVECRYIHNWSMGKCAMEIGYSEKTLFLMKKSLLDKLLVSLAAITNI

SEQ ID NO: 5153 - protein, 95 aa, Bacillus licheniformis
MDFSEIALVPLITGLVHTVKLVGIQKRFLPICAIVFGISISLLFTAGNWKEDMMIGTWLGLSSVGFYSGSKNVLKPLSKEEIEHEDLFGSGTRRK

SEQ ID NO: 5154 - protein, 225 aa, Bacillus licheniformis
MKIYLDPGHGGSDPGASGNGLLEKDVTLAIALKINDILLKEYAGAETRLSRTTDKTVTLQERTDDANSWGADLFVSIHTNAFDGTAYGYEDYIYSGLSDESVTALYQRIIHGEVIKQNGLRDRGMKKANFHVLRETAMHAVLTENGFIDHPEDSAKMKSAAWIEQTARGHANGIALCLGLTQREFPLYKVTMDGGQIGAYQEKDDVLKVISANWDSFQKAAIEKG

SEQ ID NO: 5155 - protein, 118 aa, Bacillus licheniformis
MMAAAFMIAGGIGSVLRFWLGNVLMAMIPRPRIPVSVMVINILGSFALGIFISLGIDNQTVSIVVGTGFFGGFTTFSTFSVEAVQLLAAKRVKASAVYILLTMAGSIGGFWAGSMLIP

SEQ ID NO: 5156 - protein, 132 aa, Bacillus licheniformis
MKSYVAVFIGGAIGSLLRYAVNLLGGTAVFPWPTFIENTSGSLLLGLLTGFFAARAKKPLVQLCLGTGFCGGYTTMSAFSKETVLLLQSAAHIGVLYLMASLACGVCFAFLGIVIGKKVSGAAGKEKERYQS

SEQ ID NO: 5157 - protein, 234 aa, Bacillus licheniformis
MHIIAHRGASAYAPENTFAAFEKAVELGADFIELDIQITKDGKLAVIHDDKVDRTTNGTGFVREYTMNELEQLDAGSWFGPEYQGEKIPSLEAVLRKYHNKTGLLIEIKSSKTQPGIEKAAGQLISRYGRSMNTIVQSFDAGAMRAFHHMYPSIQTAVLIRPRFGLLPRGRLRQIASFAQYVSLKATMISPFLIKSIHSCDLKALAWTVNGQKTGSRLKSWKIDGIITDYPDYF

SEQ ID NO: 5158 - protein, 35 aa, Bacillus licheniformis
MGKGRIKVEERIKIETDAEMFKATLLDQTQSQKKK

SEQ ID NO: 5159 - protein, 358 aa, Bacillus licheniformis
MFEKYMTMDFAADIGISIGILLLFFAFRKIFTKYLFNLILKLTNKTKTDFFNQVVLAFEKPARWFFAILGIYLAIIYSPFFEGHMGIVHKLYRVSVILVIVSGLYNLTAASSVLFDKINKRLELDMDDILAPFLSKILRFIIVALGISVIAGEFNYDVNGFVAGLGLGGFAFALAAKDTVGNFFGGVVIIMEKPFTIGDWIETKIVTGTVEDISFRSTKVRTAGEALVTVPNSVLANEAIMNWTKMRKRQVTFTLEIDPSTPREKVERCVERFKEMLESHEGVNPDVIMVNFDVLKDTHLSIFFNYYTNTTVWAENLDVRQDVNYRILDIMKEEQVDFVSPGHSLFELKKMKDQQGNA

SEQ ID NO: 5160 - protein, 249 aa, Bacillus licheniformis
MEEEALRFADMIENAERITVLTGAGMSTESGIPDFRSAGGIWTEDLSRMEAMSRDYYERYPKLFWPKFKELFQMKMTGTYRPNDGHLYLAELEKSGKDVRVFTQNIDGLHLKAGSRHVYELHGSIQTAACPKCGARYGLDHILQEEVPRCNRVNGKGRACGFILKTDVVLFGDAVQHFDTLFEVLNESDLLLVIGTSLEVAPVRFVPEEAHLIPGLKKAMINLDETPYDHLFDIVINQKIAEFVRKLNH

SEQ ID NO: 5161 - protein, 163 aa, Bacillus licheniformis
MKIEELHSTAEYANQLAELLIRVVDDGASVGFLPPLEKRLAEAYWKTAVAPDSVLWIAKQNGRIAGSVQLHLCTKQNGRHRAEICKLMTDPAFRRQGVAKSLMQKRSTGETGRQTLLVLDTREKDPSNLLYASLGFAEAGRIPEYAESADGRLDASVFYYKKL

SEQ ID NO: 5162 - protein, 303 aa, Bacillus licheniformis
MRQVSKKTAPSVAYLLTKAACFFVLCLILLYVWDLSQSSAATEKRELTVSENSQMRHEGDSVPLKKATQGELLDHLSTKQQIEKRKQEKEKQKAAAEKKKEKSKEKTVYLTFDDGPSAVSQRLLQILSEHDAKATFFMLEPNMKLHKEAVLNMKQQGHALGLHGVTHDQKQFYKGANSPNLEMKQAQKTLKSITGVETHLIRTPYGSKPSLTEAQKKVLKKNGFIYWDWNIDSLDWKYRSQKFVPEVMNQLNILEKRQTKQPIVILMHDIPSTVQSLPLLLTNLKNMGYSFATLDESMTPVHE

SEQ ID NO: 5163 - protein, 283 aa, Bacillus licheniformis
MKVLFNGRLIERSECAVDIEDRGYQFGDGVYEVIRIYNGILFTLDEHIARLYKSAAEIGIDLSFSEAELKSQLKELVDINQMREGGLYLQVTRGKAPRKHQYGAGLTPQVTAYTFPIQKPEKEQQNGVSAITADDMRWLRCDIKSLNLLYNVMIKQKAHEASSFEAILIRDGLVTEGTSSNVYVVKQNAIYTHPATTLILNGITRMKVLQLCEENGLNYVEKAVTKDELLNADEVFITSTTAEVIPVTSIDGQTIGSGAPGPLTKNVQTALQNSILSETAKTV

SEQ ID NO: 5164 - protein, 452 aa, Bacillus licheniformis
MSNEKRLSFSISALLFMAILFIIFTCLFIFKAEPHIPLLICVGFLAAVGAVKGHSWKDLESGIVSGIRNGVQPIIILCLIGILIGVWEYSGAIPTVTVYALNLIEPQHLLLTALFSCLVISSLVGSSFTTVSTIGVALIGVAAAAGVPLTWAAGAVICGACFGDKMSPMSDTTNFAAGVGELPIFKHIRHMAGTTIPALLITILLFFFMGRSLTAAPASTENIQAIINGIEGMVNISVFTLLSPLLVIVLAVRRTPVIPSLAAGIVSAGIFAALIQPDAGISSFLSAMQNGPVFSADTEAVEKILNRGGLQSMMGSVSLIIIAFALGGLMEKIGMITSLLEGVIKGIHTKGRLVFSTVSSSIGMNLATGEQYLSILIPGQSFKKLYDKLGIDRKHLSRSLEDGGTLINPMIPWGVSGAFMSTALGVPVIEYLPFVFFLYLSPLFSILFGFRK

SEQ ID NO: 5165 - protein, 326 aa, Bacillus licheniformis
MSCTVQKSRFLHEEAIRFENDDLEAVLVPGWGSNLISLRWKAGGLNLLKTPETKEEYDANPFLFGIPVLFPPNRIDHGRFTYAGRTYELPINEKPLENHLHGFLYDKKWTVKKMEATEERIIVQTMLDSDDHPGIKSIFPHSFSITITYTLEGQHLKIDASAVNRGQDPMPIGLGYHTSFRYPLNESGDKEKCLFTLPASKHWTLTDRMLPTGEYRVTEEFKAGKMAAGERLDDILAAEQDQEGNSTAVIADSLAGIRVRYQCDGHFKHWVVFNGTSDQDDLLCIEPYTWMTNAPNVNLPKSVTGFRDLGPQEELTMRSKIEVGGI

SEQ ID NO: 5166 - protein, 158 aa, Bacillus licheniformis
MKQEYKRPVLFIASLFMAFCAVYFGGRLIGFYMAEYPKWNGQSADGNWEAVIKKIDGRALFGGELYWTGDRGKLDDTYLEKLVVKFGDEIVLNAQIETPVKDYAGGKFPGGGSKEQSVSFLEGLEEAEIAGREVTVQLDWREGKQASHTGFTLDKSSW

SEQ ID NO: 5167 - protein, 644 aa, Bacillus licheniformis
MKRCILVVGEGLMAEGASQQLSAEYNVIRRSDFENRIPAETSFVLVLHDAWRPLLYREAEKVLRAAGIPWLRGFASFGEGVIGPLVYPSESGCSKCADMRWYVSGPDSMETLELEQKSNDINRDPWASKTGCRQMVSLICTEVDTIMNGGRGRLEKKLYIVNLKTLESSLHAFIPEPTCPICGNLPEDGPESARISLRPSLKTNPDSFRVRNTDDLKQTLSKDYLDQRTGIFNAKIYDAILPFADMIVNIPLWMGNEGVGGRSHSYEDSELTAILEGLERYSGIEPRGKRTVVHDTYENVKDRALDPAKVGLHQAEQYTHPDFPFQPFHPARPLRWVWGYSFLQKRPILVPESLAYYSLGREDSFVYETSNGCALGGSLEEAIFHGILEAAERDSFLLAWYARLPLRQLDLDSSGDPELRLMTERVRSVAGYDLHVFNSTMEYGIPSIWAIAKNRKREGLNLICSAGAHPDPVKAVKSALHELAGMMLKHDRKFESERSKYHQMLRSPALVREMEDHSLMYGLPEAEERLSFLLNQSRPLQTFDDAFKKRKKHLDLTEDLCDLLEAFRSLNLEVIVVDQTSPVIKRNGLYCVKVLIPGLIPMTFGQRFIRLEGLERIFTVPKKLGFAEEPLRPEQLNLHPHPFP

SEQ ID NO: 5168 - protein, 617 aa, Bacillus licheniformis
MTHLTASARLKVNRDTWFLPDPNGGAYFRNNSGSFRLKGSSIAQWFEKLLPMFNGEHSLEDLTKGLQAPYRKRVYEIGETLYKNGFVRDVSRDHPHKLESSVLKTYEAQIEFIESFADSGAYRFQLSRQTKILAAGTGSFLTKLVRSLIDSGFSRIRAIVTDASGHALDELAEISEQTESGLEIGFAETQHWREAVRSADWVLYVSDRGFTDDLHDLQTFCLEENKGFIPGICLKQVGLAGPVFQQHGDSRFEAAWRRLHRSALHEERTLGTFPLAGKDMLANVIVFELMKAAAELEPLSKKNQVYLLDLATLEGGWHAFLPHPDFSCGKDSAELICDLEAKLSEHPGKETESRLFQCFTELTSPVTGIFHLWEEKHLPQLPLAQCFVQTADPLSSGPAELLPETVSVGLTHQEARREAGLTGIEMYASRLTRSYPNNGDFAIATGETLAEGVLRGLEKCLEHRLCERIKSGKEMISLVQLDGIEDRHSAFYLKALTVLYGQPEIGLGKNIEGFPVAWAGIRGRWYRSSGLNITSALRKVLERALTDKDPLKGADVLLEPGELKLAIPVSAALQKTLLSALKNNRGLQLYVYELPVEPFLKEKLAGIYCVQLRKEEP

SEQ ID NO: 5169 - protein, 166 aa, Bacillus licheniformis
MFKADRIIVAFDGKEESKKALRKAIDLSKRLGSQLTVAHVHEPRQVRTEAAAERPAAGAPYLYSGFPAAPRIPRDSDLAGEPMIYEDSAEEAIAAAKIILSENQYDAEIEVLEGDTANAVLQHAENIGADLVITGTRDQNRLKKLLFGSVSDKISTKSEIPVLIVK

SEQ ID NO: 5170 - protein, 584 aa, Bacillus licheniformis
MFSVLWKLGWFFKASWRRYTIAVVLLIIVNVLEMFPPKLLGNAIDDMQAGTFSKAGMLGYIGLFLALGAVVYTLSYYWMYQLFGGANLVEKILRSKLMGHLLKMTPSFYEKNRTGDLMARATNDLKAISMTAGFGILTLVDSTMYMLTILLTMGFLISWKLTLASIIPLPLMAAAISIYGKKIHERFTEAQDAFGALNDQVLESVSGVRVIRAYVQEKNDVSRFNSMTADVYKKNMKVALIDSLFEPTVKLLVGISYLIGLGYGAYLVFRSQLTLGELVSFNVYLGMLIWPMFAIGELINVMQRGNASLDRVNETLAYEPDVREPAEPEAAEPGDIVFDGVTFTYPSSASENLADISFTVLEGQTVGIVGKTGSGKTTLVKQLLRQYPQGKGTITISGVPIERLPLDQLRSWIGYVPQDHVLFSKSVKDNILFGGHLAEERDLHAVISAAHLKKDIEMLSDGLETMVGEKGVALSGGQKQRISIARAMIAEPHILILDDSLSAVDAKTEAAIIENIRSRRKGKTTFITSHRMSAVEHADFILVMEDGRIVERGTHQELIGRKGWYFEQYEAQQLPSGEEGGTVA

SEQ ID NO: 5171 - protein, 672 aa, Bacillus licheniformis
MTTGKRLFQYALLYKKILIWALVMLTIAVTAELTGPMIAKKMIDDHILGIEKTWYETTENSKYTVSYKGKEYIREDRTDPSAEKLQEVHIFQVGMNYYFVGKPVSFDGERTVSGGELRMTSGDRTETYKADRLSLSEVYAFYEPEIGGLISLVSIYFGLLIFSIFFHYGQFYLLQMSANRIIQKMRQDVFANIQRLPIRYFDNLPAGKIVARVTNDTEAIRDLYVTVLSTFVTNIIYMAGIFAALFFLDVRLAGVCLLIVPLIVIWAAVYRKFASGYNHKLRSINSEINAKMNESIQGMTIIQAFRRGQDTKEEFEQLNDSHFHYQNKMLKLNSLMSHNLVNILRNVMFTALIWYFGGAALNAEGMISIGVLYAFVDYLNRLFQPITGIVNQFAKLELARVSSERVFRLLDEPGVDVKEPSSERARGRVVFEDVSFRYHDGEDVLKNISFEAKQGETVALVGHTGSGKSSIMNVLFRFYDIEKGDVKIDGRSIYDMSRQEIRKHMGIVLQDPYLFSGTIASNVSLDNADITREQIEDALKQVGALEVLARLPKGLDEPVIEKGSTLSSGERQLISFARALAYDPAILILDEATAHIDTETEAVIQKALDVVKQGRTTFIIAHRLSTIKNADQILVLEKGRIIERGNHEELMKQKGQYYQMYELQKGKGTLIG

SEQ ID NO: 5172 - protein, 215 aa, Bacillus licheniformis
MIDPMGVIMLKIALFGGTGRVGQAFLNFVEEDGHHSVNALVRRTEGARIPDLCQAHIGNARNRHDVESLIKDCDIVVSCLNTDGDDTLTVSIEHIINAMNVHRIKRLITIGTAGILNARQNPALYRFETNESKRRSTRAAQEHARVYERLRESDLDWTIVCPTYLPDGPALKTYRFEQDVLPPGGREISTGDTAHFLFTQLESDQFVKARVGLAY

SEQ ID NO: 5173 - protein, 67 aa, Bacillus licheniformis
MANQNSSNQLLVPGAAQAIEQMKFEIASEFGVNLGADTTSRANGSVGGEITKRLVSQAQASMGGQQF

SEQ ID NO: 5174 - protein, 73 aa, Bacillus licheniformis
MCPVCNGILVQTRHCPKCGGEMADAGRATDFFGPYSPYMEFDSFKQTQTACVHLYTCQDCTYEETVEIETTEA

SEQ ID NO: 5175 - protein, 368 aa, Bacillus licheniformis
MAELVLDRIYKVYDNKVTAVDNFNLHIEDKEFIVFVGPSGCGKSTTLRMIAGLEEITDGEFTIDGKRMNDVAPKDRDIAMVFQNYALYPHMNVYDNMAFGLKLRKFPKDEIKRRVHEAAKILGLEQYLDRKPKALSGGQRQRVALGRAIVRDAKVFLMDEPLSNLDAKLRVQMRAEITKLHQRLQTTTIYVTHDQTEAMTMATRLVVMKDGIIQQVGAPKEVYENPENVFVGGFIGSPAMNFFTGTLKEDMFTFDGVSVRVPEGKMKVLRGQGYVGKEIIMGIRPEDIHDEPVFIEASKDSKVDAKIEVAELMGAETMLYSQAGTQPFIARVDSRTDVQAGDTIPLALDMNKAHFFDKETELRIRSEG

SEQ ID NO: 5176 - protein, 293 aa, Bacillus licheniformis
MLEKLKTLYGERMVGSKAVSKHDALWFQTDEGETFGVLKSAVTDREKELLYCLFRPFSEPHRPQQLTKREKEWHEYFFCDAPLQNPGNIQLIQGHFFKMEHAPEERQAIKEAVSGFFKDPLVVWYDRHEAVIVHENPSPFLAKKELSELADALTSDFMATPVFFSGQLHPVNGSLQGKIRFEKQMFHYMLEAGDIGNVATFCQCLPSFLTAKPERVHASSFSDAVREALSDPETSLTIKTYMRCNLNASLTAKRLFIHRNSLQYRIDKFIERTAIDIRQFEEAAAVYLMMHLL

SEQ ID NO: 5177 - protein, 69 aa, Bacillus licheniformis
MISHFQWKPLFKKERLPGWKISFYHKGIHYEGIYHKSGEIEWGSTYPPHDDEPSLKSEIHELMLFHIYE

SEQ ID NO: 5178 - protein, 452 aa, Bacillus licheniformis
MTGQPLTVGIHQTSENTMLLPASFKQDGLLFAAFGTSVERCHVSFDSHLKRTVLLSENLYKNLRIPYRGKASLLFRDNTVYIGPLIGIFTAGFTKSQLDPVRGRSLFFSKLLTMDLPAGGYSYLFGAHQINWEEGTVQALIFRENGWEEAIVPLPNVVYDRLPNRKAEESSALRETKKRLMDEYRIPWFNPGFFNKWEIYECLQQDERTAELLPFSALEPDADKIEDMIDQYGFIYVKPAGGSFGKGIFQLSKREENGILARHAEGVTSFSSAAECLKEWQMLHKHTSYLAQQGIERIEVDHHPADFRVHTNKNGKGQWTVTAIAAKIAGKDGITTHMSSGGAVKTLAEIYDDPQERLHTLQKLTKAAVLLSRVLDEKLDGFIGEIGFDLGLDRSGKVWLFEANSRPGRGIFSHPRLASVSRLTKKRSFEYASYLTEQSILNPEDMWHDLKP

SEQ ID NO: 5179 - protein, 361 aa, Bacillus licheniformis
MITLGFMSLSHGHEKAYAEELAKVASDYGIRFIRFTPLDISPGSLLVKGLSFHPKSGQWNEIEREIPELIYDRCFYGRDQQSKKAKPIVEWLKKYPKTTFLGLGLPDKWTVYKALKADPVIKSYLPATTIAENAQDILRKLAKEKSCILKPASGSGGRGIIHLELTGKTVKAAYQTGKHKQLKSFSKQASFETWCQKVLQHRYLLQSFLDIQDKDGFPCDIRLLLQKNGYGEWETAGKTVRRSYQHGLLANLAGGSEAVSFDSWLLSVPKKRQAVLLDDLETMAQAVPLALESNHGPLFELGLDICLTKDGKVWLLDVNSKPGKHAFIKHSPEKRELLYKGPLEYCSFLTASAGAKGAEKR

SEQ ID NO: 5180 - protein, 376 aa, Bacillus licheniformis
MYVFGIFAVMIAVGALIGAVTNHFAIKMLFRPYKAIYIFGKRVPFTPGLIPKRRDELARQMGQMVTGHLLTTEGLKKRLASDAVKSQAVQVGERLLARLSQSTATVEEALESIGISNPAQKADRAVSRLADEKLTAFLEAYENEPLKKLFPLEAQEKLKEKIPMVSSYILSRAVSYFESDEGKERLGHMIDDFLKERGMLGSMVQMFLGNSSLVDRVQPEIVKFLKNGETAGLLQDLLENEWDKLKEYTFKEADDKWNLKPLIFDLKEKLLKRFSLQPFFEKTIGSSISSFEQDIALRLPQMADRLLEEAGRRLDQALKQLELEQIVKEQVDNFPVERLEEMVLSISKREFKMITYLGGLLGGIIGAVQAIFVILI

SEQ ID NO: 5181 - protein, 117 aa, Bacillus licheniformis
MTVNLHDSAYDLEQALRQSEEYSRLKNLYDEVNGDPSAKKMFDNFRDIQLNLQQKQMNGEDITQEEVEQAQKSVALVQQHEKISQLMEAEQRMSMLIADLNKIIMKPLEELYGNPES

SEQ ID NO: 5182 - protein, 287 aa, Bacillus licheniformis
MSKQMLALNIDGTLLRTNGRLHPATKEAIEYAKKKGVYVTLVTNRHFRSAQKIAKSLKLDAKLITHSGAIIADKIAEPLLEKRISEEQTFNLVQILESYDCNIRILHEKYSIGNRKKTNSNLLGKTMIHPSDPIFYPVQFVDSLSDMLMDEPVSAPVIEVYCSTGQSEEIRQTITNAFPLVDIIEAGEKMLIVHKGVSKEAGLTMLAADLGLKMEDVVAIGHDIDDLPMIELAGLGVAMGNAPQEVKQKADWVTRSNDEQGVAYMIKEYFRMQQSKGFLKKFHIKKI

SEQ ID NO: 5183 - protein, 528 aa, Bacillus licheniformis
MYVSRIDFAHLFLYTKESFETKKVMTLRIYIEGLQDERFQRPLEHIANLFFEESEVALGEEAPADLAIVLGYEREENGVKASGAIKDTDITAEYAKNIDPKLTEKEAFKQVKNTVSYVFLSMLQEHTGIIQKWGILTGVRPTKLLHKKLESGMPKEEAHAELKRDYLIHDEKIELMQNIIDRQLKAVPDLYELGQEVSIYIGIPFCPTKCAYCTFPAYAIRGQAGRVGSFLWGLHYEMQKIGEWLKENDVSITTVYFGGGTPTSITAEEMDLLYEEMHRSFPDVKNIREVTVEAGRPDTITEEKLAVLKKWNIDRISINPQSYENETLKAIGRHHTVEETIEKYHLSRNAGMSNINMDLIIGLPGEGVKEFRHSLSETEKLMPESLTVHTLSFKRASEMTKNRHKYKVADREEIVAMMDDAVSWTKQHGYHPYYLYRQKNILGNLENIGYSLPGQESIYNIMIMEEKQTIIGIGCGAASKFVDPRSGKITHFSNPKDPKTYNDRFEHYTNEKIRYLSELFQKDGSQQE

SEQ ID NO: 5184 - protein, 258 aa, Bacillus licheniformis
MEYIKWKDEDGIFEIVLNRSEAYNALNEKMLEELNEALRVAEESESLLLLVRGSGKGFSAGGDIKMMLSSGDQDSSARVIDTISEIAVKLYSMPKMTTAAVHGAAAGLGLSLALSCDHVLVEKEAKLAMNFIGIGLVPDGGGHFFLERRIGETAAKELIWSGKKLTGAEAHELRIADAVFSGDSGRFARIYLEKLLHAPLAAMIETKKIYQALNGGRLQKTLELEKTAQMKMRLTSDHQEGIRAFLEKRQPQFNRQQV

SEQ ID NO: 5185 - protein, 372 aa, Bacillus licheniformis
MKQKIPSEYVARKLNDWYNAIRKNQIAASESLKAEILNDFQDMEENRDVLLYYSLLEFRHKLMLSYLKPKETENIEKNLRDLEEKEDQMTGLLNYYYWFFKGMYEFKQKRFVKAIGCYKTAEQKVSALEDEVEKAEFYYKLAEIYYYINQRYLSINYATLASDIFNRYETLKEKKIFCDFIIAGNWVESMTYGPALKSLANALEDARKIKNSHLTAAAHFNLGNCYFHQESYREASDHMESALSIFEQESSSYIPKVLYNLMYVRLKQGNHAGAAACYEKGIRSAASLGDEEHAAKLNILCGLYLDGGDQKAVENGFDYLESNHLYAAVEELALDAAQYYNQIERLKDSIFYYEKCAQASRKIKRGDALYES

SEQ ID NO: 5186 - protein, 61 aa, Bacillus licheniformis
MENYYVTVFDTSGETLLNERFEAADDEEAKEKGRGMLKEKQFLEHTHRVVHSSGKIIVFRS

SEQ ID NO: 5187 - protein, 298 aa, Bacillus licheniformis
MLKIDHVTKRFGSFTAVNDLTLEIPDKQMFGLLGANGAGKTTTFRMILGLLNATEGTVTWKGQPINYGVTNSISYLPEERGLYPKLKVKDQLVYLGRLKGMTKQNALKEMEKWLERFHITEYADKKVEELSKGNQQKIQFITAVLHKPELLILDEPFSGLDPVNVELLKDAVISLKDDGTSIVFSSHRMEHVEELCEHVCILQRGTPVVQGKLKEIKRSFGRKNVTIHADGDLSFLKEADGIVKWRDHSEGVRLQVENEEVSQELFTMLQGRGFIRKFELEEPSLHDIFVEKVGARYE

SEQ ID NO: 5188 - protein, 422 aa, Bacillus licheniformis
MNKFWIVLFHTYISKLKTKSFIISTAITLALVVLVTNLGSIISMFDDGGEGDKIAVIDRSNQLYDTFAQQVKALDTDEALEVQKADKPEKELEKDVRDEKLEGILILERDKKGVLKGTYKALDIADSTAVSTIEQALSQAKIAVGTAELNVPQEKLSELFTPVKVNSVALKEGAKTEEELQKATGLVYVVLFVIYFSVLMYASMIATEVATEKSSRVMEILISSVPPVQQMFAKLFGVALLGLTQLAALLLAGYLSLQSSQESGGDAAELVKGFFDVSGVPTATLVYAVIFLMLGYFLYATLAAFLGSVVSRIEDVQQMISPMILLVVAGFMIAMFGLNAPDSTFITITSFIPFFAPMIMFLRVGVLDIPFWEAALGIGITALTIVILAVIGARVYKGGVLMYTSGGGLKNIKQALRLSKDR

SEQ ID NO: 5189 - protein, 408 aa, Bacillus licheniformis
MTNITFIHAADLHLDSPFHGISQLPEEIYQRIKNSTFKSAENVFKLAIDEQADFILLAGDLFDEANRSLKAQMFLRKQFLKLKENNIQVYVIFGNHDHLGGDWTPIEWPDNVHIFSAEDIEEKSFYKDGRLAASIYGYSYPERSVYANKAAEIKKTTDAPLHIGMIHGTLSGESGHDPYCPFSLQDLKNGQMDYWALGHIHKRQVISAADPAVIYPGNTQSRHMKETGEKGCYLVNVCGGELSFEFKAVSDVLWETASIDISGTKQMTELISLMHDAFQSFRKRGKPACVKMVWTGETPSYLAEGQAGIADEILDIFHEEEREEDAFIWLTAIEDQTDAALSGIERDAFFQELLQEIHEFQDFSLILDDLERHPVFRRHGELFNEEDFRDIRTQAEKLLLHELKTLKR

SEQ ID NO: 5190 - protein, 988 aa, Bacillus licheniformis
MNIHAIHIYGYGKFANQTFRLSPSNLHLIYGLNEAGKTTLMSFIESVLFGFPKTKRYEPKTGVIYGGMLEVGHPDFGQIRIERTAGKPERVTVYLEDGSTKPEGFLNELLSGIDRQLYKAIYSFDVFGLQEIHKFNRDKIGRFLLFSSLFGSDAISKLDAGLVKKQEELFKPNGRKPELNQELDRLKRLSEDLKKAKAREGGYYRLLNEKKGAEASIKESGQLLKDLEHLVLQIEQAIEILPAAAEMRQLKEQLASLGGSEESRFPEGGLFELEKLESHLHPKAAQLKALEEKKRGLEQRAAAFAPAEDFLEHEAEAEELLTAYPFYQSYTEKIASLTEQLHQINGRVQAGLDRLQIEEYDILNADTTYEYEWKLQETVQAYIELRELKRSLDERFEQARADLEEAEQAHAALSNEVMPDDVRKQKEETLGRLASAGGHAGRREELILQLSYLKQEQKVRMKRRRTAFAGALCAAFAAAFAALFFKEWFPGALLAPILLIFAAFILKKPEPSAAAAFIQKQLDDIDHSGSKGGVSDSALREELWKDDQTRQLLIAKQAELRQKEAEYERAIQKFEEWEKDIRPYQEKTERYLKELNLSIDPSFLADAYALIKELREEILKKRDIEKELSRLHAKKASFEAGLRKLVTSLSLAGGSVQEQVFQLKSELESQKEKLRQKQEADVSLKHAAEQIKELAKEVEYFQSQIAELFQKAGADGREMFVGLAKRDQARKELTARLGQLKRELGRQDEKAVMLASGHSLAELKGKLAETQEKRARIEKQLTEERQTAANFHAELARLEESGAVSELAYQTGMQKERVAELAKKWAAVKLIRQAVQNKIDEHKKVRLPKLLQTAETLLNPLTAGQYEKIYFSETDDSMMVMRKDGALFCAHELSQATCEQLYLAIRFALALSHQKNVKLPFQLDDSFVHFDQERFKQVLNILKKLSGEDQQILYFTCHEHVREAFRDEDVILLPSGMKKVEGKEMTNK

SEQ ID NO: 5191 - protein, 324 aa, Bacillus licheniformis
MAKGIMLHEVGEQVDLYLLIKSSTKGIASNGKPFLTLMLQDQSGDIEAKLWDAKQQDEVTYGPQTIVKVVGDIHHYRGRNQLKLRNIRPAGENENVKIDDFLETAPIPKNEMMDAVTQYIFEMKNPNIQRITRHLVKKYGKEFIDYPAATKNHHEFVSGLAYHVVSMLNLAKSVADLYPSLDRDLLYAGVILHDLGKVKELSGPVSTTYTVEGNLLGHISIMVTEIAKAAEELQIDSEEVLILQHLILSHHGKPEWGSPKPPMVKEAEILHYIDNLDAKINMMDRALERVKPGEYTERVFALDNRSFYKPRFSQISVITCLPFA

SEQ ID NO: 5192 - protein, 77 aa, Bacillus licheniformis
MLLFPWWVYLCIVGIIFSAYKLMTTAKEEEKIDQAFIEKEGRIYIERMEKEKAKRMKRTLDEDQEQHEKSADSHSIA

SEQ ID NO: 5193 - protein, 286 aa, Bacillus licheniformis
MKKIAIAAITATSVLALSACSGGDSEVVAETKAGNITKEDLYQTLKDNAGADALNMLVQQKVLDDKYDVSDKEIDKKLNEYKKSMGDQLNQLIDQKGEDFVKEQIKYELLMQKAAKDNIKVTDDDVKEYYDGLKGKIHLSHILVKEKKTAEEVEKKLKKGEKFEDLAKEYSTDGTAEKGGDLGWVGKDDNMDKDFVKAAFALKTGEISGPVKSQFGYHIIKKDEERGKYEDMKKELKKEVQEQKQNDQTELQSVIDKLVKDADLKVKDKELKKQVDQRQAQTSSSS

SEQ ID NO: 5194 - protein, 32 aa, Bacillus licheniformis
MGDGYAGGFAGGFALLVVLFILLIIIGASWIC

SEQ ID NO: 5195 - protein, 171 aa, Bacillus licheniformis
MSCWKTINLVKDYGGMRIVLTAVSLMILFFIPEYLAMQLIHPQTVQRGDHALLFAGLLVAAIIAHKILHILPMISKKKLEKKIYWLKMRTWREIPKNMMLVSLLCPFLVITPVLFYAGAAMPSFAHYFCIISSIHFGYCLPDFLFAWKLIKAPKNCFVDQEADDFDILIQK

SEQ ID NO: 5196 - protein, 115 aa, Bacillus licheniformis
MNSMEQRLERLEYYIKLLLNNADMEEYPYYKILIEKGLSEEEAKETEKLCEELSKELEAQKAQGFVMFDHLLTLFAGQLNEKLEVHETIFALHRQGLYKPLMSEFISIIRQYDLA

SEQ ID NO: 5197 - protein, 206 aa, Bacillus licheniformis
MNRAEEPYTVKEALLFSQRMAQLSKALWKSIEKDWQQWIKPYDLNINEHHILWIAYQLNGASISEIAKFGVMHVSTAFNFSKKLEERGYLEFSKKLNDKRNTYIQLTPKGEEVFLKILESYDPTRNAVLKGAQPLHQLYGKFPEIVEMMSIIRHIYGDDFMEIFEKSFSNIENEFTSEEGKMKKKQEAKEAGESIEVDKPLEPLKN

SEQ ID NO: 5198 - protein, 118 aa, Bacillus licheniformis
MSKGRSLAAGLIVGGVIGGVAALLTAPTSGKNLRGQLKANCGKWEDTVKRLKNDGIALKEQFVKTAIEGAEIIKDVGSELQTSIQEWREEIKPHQQDLKKEIAEIEEKIKQLEKTLQN

SEQ ID NO: 5199 - protein, 175 aa, Bacillus licheniformis
MKTKELVAMALFVAIGAALHAVIPPFFYGMKPDMMLIMMFMGILLFPRLQNVLVIGAVTGVISALTTAFPGGQLPNIIDKPLTALMFFGVFLLVKKLNSKTLAAAGLTAAGTVLSGTIFLTAALFIVGLPGNQGFITLFSVVVLPAAVINTIAMAVIFPIVQSIMKRSRLIEQVK

SEQ ID NO: 5200 - protein, 357 aa, Bacillus licheniformis
MIRTTNFNAGPAALPLEVLQKAKDEFLDFNGAGMSVMELSHRSKEYDAVHQKAKALLKELMDIPDDYEVMFLQGGASLQFSMIPMNFLSKDKTAHFIMTGAWSEKALAEAKLFGNTSIIASSKEDTYSYIPEVPEIPADGAYLHLTSNNTIFGTQWQKFPDAPIPVVADMSSDILSRKIDVSQFDIIYAGAQKNLGPSGVTVVIMKKDWLGKENEQVAKILKYSTHAKADSLYNTPPTFAIYMLSLVLEWLKEKGGLDAIEKRNREKAGILYNAIDESGGFYRGHAREDSRSNMNVTFTLKNDELTASFIAKAKEEKMSGLGGHRSVGGCRASIYNAVSVEDCEKLAAFMKKFREEN

SEQ ID NO: 5201 - protein, 139 aa, Bacillus licheniformis
MSDCIFCKIINGEIPCAKVFENEHVLAFLDISQVTKGHTLVIPKVHKTNIYEMTPEVSREFFEAVPKIAQAIKDEYEPIGLNLLNNNGEKAGQSVFHYHMHIIPRYGKGDGFGAVWKTHADDYSPEDLQNIAASINKHL

SEQ ID NO: 5202 - protein, 100 aa, Bacillus licheniformis
MTKTSNKAGAFSIQWMKEISKLDMFHTQDSCRILSLTNTSFARVDKLSLLQELECPKALSIIRFIFTAEKREGKRFKYILVFGTIKKNAGKERTYVTTDC

SEQ ID NO: 5203 - protein, 246 aa, Bacillus licheniformis
MSLLTVKELTGGYTRNPVLRDVSFAIEREQIVGLIGLNGAGKSTTIRHIIGLMEPHKGSVELNGKTFMDDPESYRSQFTFIPETPILYEELTLKEHLELTAMAYGLSKETFEKRLPPLLKEFRMEKRLKWFPAHFSKGMKQKVMIMCAFLVEPDLYIIDEPFLGLDPLAINALLERMNEAKKNGSAVLMSTHILATAERYCDSFIILHNGEVRAKGTLEELREQFSMEEASLDDLYLELTKEESYE

SEQ ID NO: 5204 - protein, 407 aa, Bacillus licheniformis
MNSILGIWKTRIEEYVKETRSYLKYMLNDHLVIVMIFFLAGAASWYSKWLKEMPEGFPAYWVMAVIFSLILTGSYVRTLIKEADLVFLLPLEAKMGPYFQQAFRFSFLTQLFPLAAAALALAPLYFEASGKGFSAYLVLLIQLLVLKGWNTAMQWRMTFFGEKNMRVTDRFVRLLLNTIGIYFALESSYAFAAAVYLIMAALYVYFKVIDKKKSFKWELHIEDEIRRKQRFYRIANLFTDVPHLRKQAKRRAYLDWMLRFIPYEQSRTFTYMYGRAFIRSNDYFGIVVRLTVIFGIIIAYFSAYEWVSAALIVFTVFITGIQLTPLFDHFSHLPLQELYPVKAEEKRKSFFGLLHIVLSVQALVLSAAAGAMMQWTGMLAGLAGSALLIFVILKPYFSSRLKKSAKR

SEQ ID NO: 5205 - protein, 236 aa, Bacillus licheniformis
MNENQLYLEEATRWKMKFLRKPSMAERMSKGVQSKINARIPAKVHKAITESIKKMVEATLLGSNLTTFDKKTGTLSLREKDELAQKTIAQYQKAAAVEGIGTGAGGIFLGLADFPLLLGIKMKCLFELASIYGYDIKEKEERMFLLYIFQLAFSGEAHRKEIFRMIEHWDTEKREIDWQAFQQEYRDYLDLVKLLQLVPGFGAVVGGTANYKLLGHLGETARHVFHLRLIHETAGY

SEQ ID NO: 5206 - protein, 410 aa, Bacillus licheniformis
MSASGFVRQINNQLDAHYDEMVKLRRHFHQHPELSFQEKKTAAFIASYYEALGIPIRTNVGGGGVLAYIEGGSPGPVIALRADFDALPIHDEKDAPYRSTVPGVMHACGHDGHTATLLVLAKVLNEHADRLKGKIVFIHQHAEEYSPGGARPMIEDGCLDGVDVIFGTHLWATEPTGTVQYRTGPIMAAADRFTITIKGKGGHGAQPHKTKDAVLIGSQIVTSLQQIVSRRLDPTQPAVISTGSFVADNSFNVIADKAVLIGTARSFNEEIRTLIENEIEQVAKGICGMHGADCDYSFERGYPPVCNHPEETSFLAKIAKQTEGVEKVEESGMQMGGEDFAYYLQHVKGTFFFTGARPEDPEAVFPHHHPKFDIDEKAMLIAAKVLANAAVSYQEKEQAVRETPAMEQPK

SEQ ID NO: 5207 - protein, 457 aa, Bacillus licheniformis
MEIELTSVHFLYLGFIAAILAFMLLRLDTTFISLVGIFFISLAATHSVMASVMGMFNSLIYAAGELLPTIFIICFTVSMSELLVKTGVNEAMVTPIAKWMKGPVLAYWITGALMFIISSFFWPSPAVALVGAVLLPAALKAGLSPMAVACAMNLFGHGFALSGDYIIQAAPKLTGDAAGLPVAEVMSASVPLVLIMGFSTTGAAFLMLRKEKGNRAAASKQLQSEPEWLLPQTSRKWLALLIPVIFLGDIAAMLILELQGDEATALVGGTAVFVMILIHFIVHKHRRLEKITGYFISGFQFGFKVFAPVIPIAAFFYLGDAGFEKVLTAEIPGFSNRIVQDLGSAFAHSVPLSPEIAAVALTVTGAVTGLDGSGFSGISLAGSAASMFAAAVDSNPAVLTALGQISAIWVGGGTLVPWALIPVAAICKVDPFDLARKNFIPVAAGLTVTTIAAIFLL

SEQ ID NO: 5208 - protein, 167 aa, Bacillus licheniformis
MNFYITYGTVDFLKKLAKQHGLENMLFMKSHDSAILFHETDGESVFHSPHRYEIIDQSGSLEHSGFTVLNNIPVTPEGRPLFEARFKNRAGKIENQPGFKALRVLRPKDSDTYIVLTLWDREQSFQDWKNSKSFSEAHQKKESSAGINQGGTIFSRPSYISSYHSVE

SEQ ID NO: 5209 - protein, 712 aa, Bacillus licheniformis
MRKRFFIPIIITAAIFLLSLIGYITILFLGDYVIDEKKLIFHASSKIVDHNGEEVASLYTENRRPVSIAEVPDNVKNAFIAVEDKRFYEHHGIDFKSVSRAVYKDILAGGKVEGGSTITQQLAKNTFLTNDKTFLRKTKEVIIAINLERDYSKDKLLEMYLNQLYFGHGVYGIQAAANYFFNKDVKDLTVSEGAVLASIPKAPSTYSPILNPEKSRERRNVILGMMNEQGYISSKETVRAQGSTLGLHVKEKSKNPWLDSYIDLVMKEAEDKYSISSEQLLQGGYTISVPLDVSIQKAAYTLMKQDGYFPGTDNKAEGSAVFIDNRTGGVVAALGGREYAPKGYNRATAQRQPGSTFKPLAVYGPALEEKLFKPYSMLEDKQLSYGGYSPKNYDGQYAGKVSMVDALTYSKNAPAVWTLNEIGIETVKPYLSRMGMNVPDEGLALGLGGLEKGVSPLELAGAYRTFANSGQYTEPFFIKKITDENGDVMFRHEEKSEKVFSKQTAWNMTRMLEEVVKSGTGKAGDFSGEIAGKTGSTTYTGKEGGTKDAWFAGYTPEVTGAVWMGYDKTDESHYLKGGSAYPTRLFKDILKRTNHKPERFKAPEGVKDLDRPIRLEDLESVKADYSFTPMGLITVSLKWHEQEDKRVEYRIYERKNGKETLIDTVKGKGSFSIPYANIFSDASYKIVPYNPQTKTEGKGTDYVEPKVFPSGH

SEQ ID NO: 5210 - protein, 353 aa, Bacillus licheniformis
MKNDKAFNDTFLKACRGEKAAHVPVWYMRQAGRSQPEYRALKEKYGLFEITHQPELCAYVTRLPVEQYDVDAAILYKDIMTPLPGIGVDVEIKNGIGPVIDQPITSLADVEKLGELDPQEHIPYVLETIRLLTEEQLNVPLIGFTGAPFTLASYMIEGGPSKNYNKTKAFMYSQPAAWDLLMKKLGKMAAVYVKAQIRAGAKAIQVFDSWVGALNAGDYCRYIKPTMDVLFKELKKEDVPLIMFGVGASHLATEWHDLDLDVVGLDWRMSVQEARDKGLTKTLQGNLDPSILLAPWEVIEERTKAILDQGMQTDRFIFNLGHGIFPEVSPDTLKKLTAFVHEYSASKKSSLIT

SEQ ID NO: 5211 - protein, 312 aa, Bacillus licheniformis
MGKKKMGLLVMAYGTPYKEEDIERYYTHIRRGRKPEPDMLQDLKDRYKAIGGISPLAKITQEQTKQLEKRLNELQDDVVFKAYIGLKHIEPFIEDAVREMHKDGITEAVSIVLAPHFSTFSVQSYNKRAKDEAEKLGELSITSINSWYDEPKFIAYWADQVRKIYDEMPSEERENAVLIVSAHSLPEKIVEMGDPYPEQLKESAKLIAEAAGVKDYAVGWQSEGNTPDPWLGPDVQDLTRDLSEQKGYSAFVYAPVGFVADHLEVLYDNDYECKVVTDDIGASYYRPEMPNAKHEFIDALADVVLKQLEKEQ

SEQ ID NO: 5212 - protein, 470 aa, Bacillus licheniformis
MSGERRQIVIIGGGITGLAAAFYLEKEIKKNDLPAEVTLVEASPRLGGKMQTVHKDGYVIERGPDSFLERKQSAPQLVKDLGLEHLLVNNATGQSYVLVSETLYPIPEGAVMGVPTKIGPFLTTGLFSLPGKLRAGMDLVLPASKPQEDQSLGEFFRRRVGGEVVENLIEPLLSGIYAGDIDRLSLMSTFPQFYQTEQKYRSLIIGMKKSRGAQSVGKPANKKKGQFQTVKTGLQTIVEELEKQLGITKVYKGTKVVSIERAGSAYSMKLDNGKVLHADSAVVTAPHKAAAAMFQKEDWLKGLEDMVSTSVANVALGFPEEAVQMEHQGTGFVISRNSDFSITACTWTNKKWPSTTPEGKVLLRAYVGKAGDESVVEQSDNEMVKIVLDDLKRIMKIDGEPEMTCITRWHEAMPQYHVGHKKRIKEIREGLEASYPGVFITGASFEGVGIPDCIDQGKQAVADVLSHLFE

SEQ ID NO: 5213 - protein, 193 aa, Bacillus licheniformis
MRNREQRSKALILEAATKSFTQFGYKATTMDLVAKLANVGKGTIYTFFKNKEELFDDIFSSLLIEMKQTADQAIDPDLPFHENAHRAMMAILEYRKRHQLTIKIFQEGAELGTPAAREVIEKLERMVIGYIKRKIKEAIKNDDIRPCDPELNAFVIFKLYIALIFDWEKNHEPLKDEELAEMLKMYILKGLSR

SEQ ID NO: 5214 - protein, 720 aa, Bacillus licheniformis
MNVFKNQWRELITNKKLLISVIGVLFIPLIYSSIFLAAYWDPYGNVDQLPVAVVNSDKGTTYEGKDLHIGDDLVKELKENDKFDWHFTTKEKAMRGLQNEEYYMVVEIPENFSKDASTVMDKHPKKLNLIYHTNAGRNYVGAQISDKAIEQLQHSVGSEITEQYAEVIFDNFGKIAKGLGEASEGAGKLDKGLKDAKEGSEKLKKNLEKLAKSQIQFNKDGMEKFGAAFNTLNDKIHELDSGLAQFLEKSGQLHSGAQQLQQGMPQIVAGLEQMNEKAQKISKLEEAISNEKIQQLETALSNAEKAKKEISQISKNIDELEAALKNQHSEVKQIIESSNMLTQEQKAALMKQVDEKMGTVKLPEFDKLKAQIPDVSELPDLSGLKQKLEELKRVPSDVNKLYKGSQKIQQGLDALTNGLGAYNEKFAEAKSGSSKIAEGSQTLVGKFGDLQSAADKLKDGSSKLAEGAKSLDEGLGKLSDGSGELFDKLSDAADQTGDIQAGDENYNMFSDPVDVKGDKIDPVSNYGTGLTPYILSLGLFVGALMITVVFDVKEPAVRPESAFGWFMSKFSVLFAVGILQAAIACTIILWGIGLEVQSVWRFYLFSIIMSITCLAIIQFLAATMGNPGRFIAVILLVLQLGGSGGTFPLALVPKFFQVIHSALPMTYSIAGYRAVISSGDYAYMWEQAAVLGGVAIVMMALTLIYFKVLLKKGKIEEQHA

SEQ ID NO: 5215 - protein, 331 aa, Bacillus licheniformis
MKTLSKARISAIGTYVPEKRMTNKEFEKIVDTSDEWIIQRTGMKERRIAGSHEFTSDLCIKAVEDLKNRYSGTLDDIDMIIVSTTTADYAFPSTACQVQEHFGWNEVGAVDVNATCAGLAYGLHMANGLITSGLHRKILVISGETLSKTTDYTDRTSCILFGDGAGALLVERDDKDPSFITFAQDTKGDGARHLYRTGLRSDLKGEPLSGEGKMVQNGREVYKWAVRSVPEGVKKLLAQAEMELKDIDWFVPHSANLRMIESICEKTEIPAEKALTSVEWFGNTSSASIVLALDEAVKNGKLKKGDTLILFGFGGGLTYTGLIVKWGAPAS

SEQ ID NO: 5216 - protein, 345 aa, Bacillus licheniformis
MSGQKTMELIKELVSIPSPTGNTYDIIDYINRLLEKEGVETRHNRKGGLIATIPGSDKSRHRMLTAHVDTLGAMVKEIKPNGRLKIDLIGGFNYNSIEGEYCNIETASGKTYTGTILMHQTSVHVYKDAGKAERNQKNMEVRIDEPVNSEEETRALGINVGDFISFDPRVEITPSGFIKSRHLDDKASVALLIELIRTINTEGMTLPYTTHFLISNNEEIGYGGNSNIPPETVEYLAVDMGAIGDGQSTDEYTVSICVKDASGPYHYGLRKRLTALCEAHGIDYKLDIYPYYGSDASAAVKAGHDIVHGLIGPGIDASHAFERTHQSSLEQTAKLLYHYVQSDMA

SEQ ID NO: 5217 - protein, 65 aa, Bacillus licheniformis
MYFYHDHCKKDYDYDYHKKDHDCKKYYYYYYYYYYPCFKKYDYDYDYKKFDHFDHCKKKKHYDYW

SEQ ID NO: 5218 - protein, 428 aa, Bacillus licheniformis
MKRLKFGLATQIFLGLILGVAAGAIWFGNPAVATYLQPVGDLFLRLIKMIVIPIVVSSLIVGVAGAGSGKKVGRLGFRTILYFEIITTFAIVLGLLLGNIIQPGHGVNFSGAEKQDISQYVETEKEASTKSVADTFLHIVPTNFFQSLAEGDLLAIICFTVLFALGVSAIGEKGKPVLSFFEATSQAMFHVVNIVMKFAPFGVFALIGVTVSKFGFSSLLSLGKLVLLVYLALAFFLIVIFGIVGKLCGINIFKFLAFLKDELLLAYSTSSSETVLPRVMEKMEKIGCPKGIVSFVIPIGYTFNLDGSVLYQAIAALFLAQVYGIDLSIGQQLTLILVLMVTSKGMAAVPGTSFVVLLATLGTIGVPAEGLAFIAGVDRIMDMARTVVNLTGNALAAVVMSKWEGEYDAVKGQNVLNQREPADIEVSG

SEQ ID NO: 5219 - protein, 244 aa, Bacillus licheniformis
MKVTVIGCCGGFPAANEATSGYLFQSGDYSVLIDCGSAVLSKLQLFLPVEELDAVILSHYHHDHIADVGPLQFAKLVGSFLGKGADALPIYGHPFDEEQFSKLTYKTHTAGLAYDPTQPLAIGPFTFTFLKTVHPVDCFAMRVTDGVHSVVYTADSSFQEAFIPFSEGADLLISECNFYADQDGRSAGHMNSLEAGRIAAEAGAGQLLLTHLPHFGEHQKLIEEAQTVYKGAVVLAHTGYVWGE

SEQ ID NO: 5220 - protein, 329 aa, Bacillus licheniformis
MLFIDNQNITDPRINLAIEEYCLKHLDPEETYLLFYINQPSIIIGKNQNTIEEINTKYVDENGIIVVRRLSGGGAVYHDLGNLNFSFITKDDGNSFHNFKKFTEPVVAALKRLGVDAELSGRNDLMANGRKISGNAQFSTKGRMFSHGTLLFDSEIEHVVSALKVKKDKIESKGIKSIRSRVANISEFLDQKMTTVEFRSMLLRYIFDTEGEIPEYKLTEKDWKIINQISKERYQNWDWNYGKSPKFNLQHSKRFQAGSVDIRLEVQKGVIRECKIFGDFFGVGDVSDIEEKLTGVQYERKAIEEALQGVDIKHYFGNIQKEEFLDLVY

SEQ ID NO: 5221 - protein, 513 aa, Bacillus licheniformis
MNLVSKLGETAQSKPDRTAYIFGEQTETYGGLQQKIDCFAEGLREIGVEKGDHVALLLGNTPHFVIAFYGALKAGAVVIPINPAYTPTEIGYMLTNGDAKVIVALGQLLPLYEKVHESLPKVGCVVLCETGEPLQEPENTEVKMKLKSFTSIMKPPVRPFPEIDDEDTAAILYTSGTTGRPKGAMLTHQNLFSNANDTARYLTMNESDLVVAALPMFHVFCLTVCMNAPLMNGAAILIVPKFSPAEVFKLIKKHQATIFSGVPTMYNYLYQYEGADETGFRSIRLCISGGAAMPVALLKSFEERFGVLVLEGYGLSEASPVTCFNPFSTGRKPGSIGTNILNVKNKVVNELGEELPAGQVGELIVKGPNVMKGYYKMPDETAHTIKDGWLYTGDLAKRDEDGYFYIVDRKKDMIIVGGYNVYPREIEEVLYLHPKIAEAVVIGVPDPNTGEAVHCYVVPKDKTLTEEDVLSHCKKHLAKYKRPSAIVFMDEIPKNSTGKILRRALKDILTNKS

SEQ ID NO: 5222 - protein, 148 aa, Bacillus licheniformis
MGIALFFGILSITVFYVFHLMAEPFDSRNAEEIILKQAGDSEKTVSIKDRHNIAVLLDTFNKGKRMKKKTAHHLPSPAYHGYISMTGTHRVHFTVWLKKDEAVILKEEEGTYFVLQQREKDALLGELQKRDAAGVPFSGSRFVCQNVF

SEQ ID NO: 5223 - protein, 183 aa, Bacillus licheniformis
MNSIEKQVAENIKRLRKIRNYSLDQLSSMTGVSKGMLAQIEKGSSSPTITTLWKIANGLQVSFTSLAERPAGEPTVVRKHEKTPVMAGEEKYAAFPHFPFDQKKKFEIFYIELAPGCVHESEPHHGGIEEYVLVSKGALAVTAGDYTCDLNEGDAMHFTANTVHTYKNNTEQTASCYTLIYYP

SEQ ID NO: 5224 - protein, 238 aa, Bacillus licheniformis
MEKQDSLNFLDGLRSGVSLAVGYIPVALTFGLLAKTTGLSLFETFLMSALVFGGASQYMSLSMLAVQTGIIEIVMTTFIVNIRHFLFSATLNQLVEKDSPWKKAFYSFFAVTDESFAVAALRKEKLTTGYMIGLGSIGYVSWVFWSAAGHFAGAAMPAVLQESMSIALYAMFIGLLVPPLKKQRKVLLLAGAAALFNTVFQMNGMLSAGWSIVCATLLSAILIEWLYQFRTEGKRNYV

SEQ ID NO: 5225 - protein, 103 aa, Bacillus licheniformis
MFSPIIWMIIGMAAVTYVPRMLPLIAFESLKLPGFLERVLKNVPYAVLGALIFPGIFSVQSGMLYGLAGALIAFLFSYFGASVIVVVMGTILTLAGAGLLLSL

SEQ ID NO: 5226 - protein, 418 aa, Bacillus licheniformis
MRKWIAGAFLLYVLYGLFFYWYLFMAGEPSVPEALKGTSADPATFMNERELMLTEEYSKIKDFLFFIRIPFEWFLFLILLIAGLSKKMKNWAEQTSKRRTIQITAYVFALFLIVTIVSLPLDWISYQYSLDYGISTQTTASWIKDQVIDFWISFPITAAAVIVFYFLIKKHEKRWWFYAWCLTVPVTLFLFFLQPVVIDPLYNDFYPLKNKDLEQSILKLADQADIPANHVYEVNMSEKTNALNAYVTGIGANKRIVLWDTTLNKLDEPEILFIMAHEMGHYVMKHVYIGLGGYLLLSLAVFYVIDKLYKRIIGRYGKSLRIAGKSDLAALPLLLMLMGVISFASSPFTNAVSRHQEKAADQYAIELTNNSDAAVATFQELSKAGLSEANPPFLVKIFKYGHPTIMERIQNIEQSSTE

SEQ ID NO: 5227 - protein, 379 aa, Bacillus licheniformis
MMRKKSFWLGMLTALMLVFTMAFSDSASAAQPAKNVEKDYIVGFKSGVKTASVKKDIIKESGGKVDKQFRIINAAKAKLDKEALEEVKNDPDVAYVEEDHVAHALAQTVPYGIPLIKADKVQAQGYKGANVKVAVLDTGIQASHPDLNVVGGASFVAGEAYNTDGNGHGTHVAGTVAALDNTTGVLGVAPNVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSNRASFSSVGAELEVMAPGAGVYSTYPTSTYATLNGTSMASPHVAGAAALILSKHPNLSASQVRNRLSSTATYLGSSFYYGKGLINVEAAAQ

SEQ ID NO: 5228 - protein, 309 aa, Bacillus licheniformis
MKSAHVKGVLMVLAGASLWGLSGSAAQFVFERGAADAGSLVSVRLLASGVILLLYVSMKNGFQHVCQIWKKKTDICSILVFSIFGMLAVQYTFFASIEKGNAAAAAILQYLAPFFVLFYLYVKKELPPKWKDAVLTLLALSGVFLLLTGGRPDSLYIPAEAAVWGVLSGGALAFYTVFAGGLIQSFGALTVTGWGMLVGGAGFSFLFPPFRFNLSHIGAGEAAAILFVVLCGTALAFALYIGSLSYLSAKETSCLSCAEPLAAVLSSALWLGVPFNAFQGAGTVMVIITVIILSLSRERKAADSVNERV

SEQ ID NO: 5229 - protein, 325 aa, Bacillus licheniformis
MKHKYFAILFLLMISVMTACSGGSESTKTSGQDSVTVKHDLGETKVRNKPKKVVVLELGFIDALLDAGIKPVGIADDGKPKFINEKVRGKIKGYTSVGSRAQPSFEKIASLKPDLIIADSSRHSGVYDKLSKIAPTIALKNLNADYQDTLDASLTIAKAVGKESAMEKKLAEHKQKLDELKQKFGSRKQSILLLGNTNEEITVRDENFFTSQLLTKIGYTYGVGDSGKGDAENGESVNIKMTLEQLLEKDPDVIVLMTGEKDKVDEDGKRPIEKDPLWKKLSAVKNGKVYEADRFAWSLRRSIDGADELMDEIDQHLLSEDQKKS

SEQ ID NO: 5230 - protein, 332 aa, Bacillus licheniformis
MIYMKRFAPLIFVFLLLASFALSVSIGSSMIALSDIWAAVFAYDGSKLHAIIQSIRIPRALTAALIGANLGAAGALMQAVTRNALASPSIFGINAGASLAVVCLTVMFPALAAPQTAMGAAFAGGAAAALIVYAVASVFSEHDRDISFALIGVVIQAILASMTQMLLIFHEESTETLLFWLSGSLAGSSWDKLHLLVPVSIAGLLTALALGRAASVMSLGDEVSHGLGQKVWLSRLLIAFTVVALAGVSVSAAGPIGFIGLMVPHMIRYLIGADYRAVIPYSALLGAVLLLFADILSRFVYFPYQTPVGVVTAMIGTPFFIYLARRRKKGAA

SEQ ID NO: 5231 - protein, 342 aa, Bacillus licheniformis
MNNPARKTKRRRGQSAVVLCALFACLFVLIVLNLAIGDENIGLWDVLKSLAGQGDAGVRFLVMEFRMPRILLAVLAGGALSIAGVVAQFLMKNPLAAPDTLGITGGAGLGAVIVTVLFSQQSPLLLTGAAFSGSVLAAILVYLLAYRNGISPVRLALVGIAVNAFCHSGIQLLISRGSPNVNSALIWLNGSLWGRGWQDVLPLFIWCCLVIPPIWLAAKPLDIIKSGDGIAVGLGIRLERTRFLLLAGAVLLTAAAVTAVGTIGFIGLMAPHIARKLAGAETKILIPVAALVGGIVLLIADAAGRGLVPPLEIPAGLIAAVIGGPYFIYLLRREEHKKRRHA

SEQ ID NO: 5232 - protein, 190 aa, Bacillus licheniformis
MTAICLIRHGETDWNALGKLQGRTDIPLNETGKKQAKETGAFLKGSDWDVIITSPLRRAKETAEIINQYLGLEIIEMEDFIERNYGDAEGMPFEERMRLYPDKEYPNQESKEALAERLMAGVQKVSERYPDKKVLIVAHGAAIHALLSKISNGDINLENTKLVNACLSNIKFHENKWHVKDYNLSHHLSD

SEQ ID NO: 5233 - protein, 430 aa, Bacillus licheniformis
MLFKKDRKTERSFFAGESPDQTKRIRLNQHAEFKKQLAMVDLTDEDLWVLSRLKPLVTEHIETIVTRFYQNLEHESSLMEIIHDNSSVDRLKKTLTIHIQEMFSGVIDEAFLEKRIRIAHVHLRIGLLPKWYLGAFQDLLLSMLKIFENALSDEEYRRSVKAVTKILNIEQQIVLEAFEDEHARLRRLDEESKNELHRQIKDTSGSLAAIFAETTGAVQELVDKSSEIAETSRAGTKTAVSVEQKSIGGKKELEEQEQQLNQMGSSMTQIEQEIKKLEEIALQIEKIFGIVTGIAEQTNLLSLNASIESARAGEHGKGFAVVANEVRKLSDDTKKTVSTVSELVNNTNAQISIVTKHITDVNQLVNESKDKMSEINRLFDDIVSNMKTSKEQSGRIEGDLQSFLSGLQDVNAAVSQVAVSVDSLVELTKK

SEQ ID NO: 5234 - protein, 509 aa, Bacillus licheniformis
MSNQEQKLPDSPESYWRNSTDLPSFEELSEDVKTDVAIIGGGMTGLTTAYLLTKKGYSVVLIESGRILDGTTGYTTAKITAQHDLIYDELIGHIGMPNARLYYEANLKALSFIKNLVLEQKIPCDFEEQDACIYTTEEQSVQKLRKEYEAYQKLGIDREFIKDLPVPIDVKAGLVMKNQAQFHPLHYLKYLAEAVREAGGKIYENTASKEIKEGDRPKVLTRSGHQIFSDYVTCCTHFPFHDKKGFYFARLEPSRSYVLAVKPKTPYPGGMYLSIDQPSRSLRSVTIDGEKMVLVGGESHKTGQGEDTIKHYQALESFAEGVLGIESIPYRWSAQDLITLDKIPYIGPIYPKEKRILVATGYRKWGMTTSTLAAQLMTDHIAGEDNPYQAVFQPARFHPDPSIKKAISYNADVAKHFAEGKLEQPIRKPEDLVNGEGAVVSHAGKRAGAYRDEKGELHLVDTTCTHMGCEVEWNDGEKTWDCPCHGSRFSIDGDVIEGPAVEPLKDPES

SEQ ID NO: 5235 - protein, 285 aa, Bacillus licheniformis
MSKQPKKVLPPQHQTQRPGLEYLMDPRPVFDRPKRERKLAGKTAIITGGDSGIGRAVSVLFAKEGANVVIVYLNEHRDAEETKGYVEKEGVGCKLIAGDIGDEAFCNDVVRRAKEAFPTIDILVNNAAEQHPQKGIEKITSHQLIRTFQTNIFSMFYLTKAVLPHLKKGSSIINTTSITAYAGNERLIDYSSTKGAITSFTRSLALSLVDQGIRVNGVAPGPIWTPLIPSTFTEREVEIFGSTTPMERPGQPAEVAPSYLFLASDDSSYMTGQVLHVNGGTIING

SEQ ID NO: 5236 - protein, 77 aa, Bacillus licheniformis
MKEKKSYAELMKSRNTQKVKELDVTITDIYIQMVLDESLFKRRLHTLSKKINEALDKGDKQSFLELSREYTALKKHA

SEQ ID NO: 5237 - protein, 192 aa, Bacillus licheniformis
MSTEDMTKDTYEVNSSTMAVLPLGEGEKPASKILETDRTFRVNMKPFQIIERSCRYFGSSYAGRKAGTYEVIKVSHKPPIMVDHSNNIFLFPTFSSTRPQCGWLSHAHVHEFCAAKYDNTFVTFVNGETLELPVSISSFENQVYRTAWLRTKFIDRIEGNPMQKKQEFMLYPKEDRNQLIYEFILRELKKRY

SEQ ID NO: 5238 - protein, 121 aa, Bacillus licheniformis
MTRIPAEARDMIEKAIYLPMTVSILNRDMKIIQQGPFKLKDPYLHLIEQALKLAQRDLYDVKNELRRRKIKVHEVSRDEAFTMYSFIYEGYEEEHKYFNPRIRNQVSALLEHYLFKAAPDQ

SEQ ID NO: 5239 - protein, 202 aa, Bacillus licheniformis
MEQLFSYFTEENLTEFFQSYRAFGPFVAVLLPFIEALLPFLPLLVFVVANVNSFGLWQGFLLTWVGASLGSIAVFLFIRHFGQQKALGFIRRHPSVKKLMIWVEKRGFGPLFLLLCFPFTPSAAVNVVAGLSRVSLLPFSLAVLCGKFVMIFMVSFVGHDLKALFTQPLRTAAVIIVMLILWYAGKRVEHRLNVRFSQREKD

SEQ ID NO: 5240 - protein, 172 aa, Bacillus licheniformis
MKKRFLVIAGVLLVIVVGIQVKNAVFIEYKVEGVSMNPTFQEGNELLINRFAHRFKTISRFDIVLFKGPDKDIFIKRVIGLPGETLRYEDDQLYINEEKIKEPYLDDLKAVTAGGDLTGDFTLQEVTGEEKVPENEYFVLGDNRIHSFDSRHFGFVSERDIVGIVTERIDKK

SEQ ID NO: 5241 - protein, 591 aa, Bacillus licheniformis
MKKLWKIAVSAAMFVGFFANSPRIQAESNKQENEVIVVYKNTSGKETVIEQADTVEHVYRHIPAAAVTADDKTVRELEHDPDVLYVEDNLPVAAADSTALKAFSSSTAQNASAFSQWNIKLIQAALAWNKGLTGKQVKIAVIDSGISPHEELSIAGGASMVGYTASYRDDNGHGTHVAGIIGAKHNGRGIDGIAPGAQLYAVKALDRNGAGDLKGILQGIDWSIQHGIDIINMSLVVSGDSQVLHDAVDKAYKRGIILVGASGNAGNGKSVYYPAAYSSVIAVSATNEKNQIASFSNTGSAVEFSAPGTSIISTSSDRGYAIGSGTSQATPHVTGMFALLKQLYPTASNAELRKKMQFYTSDLGAPGRDHLFGYGLIRFKEVTQPLEKAQKAVGQAEKTKKKADIQTAQKAIEPLPADADKTALKKRLNTVKEQLKKTAESKVKLAEKQKKKTNADSAQKAVNELDSGTFKTNLQKRINAVRSSLLKTAKQAVAKAEKAATDSNLGKAQKAINELPAGKDKSNLQKRLNTAKKQAAAAYNKKVSAAKAKVKTAEQKRTKKTKSAAQSAVGKLKASAEKTKLQKRINAIKLK

SEQ ID NO: 5242 - protein, 413 aa, Bacillus licheniformis
MEKTIKHDPNYYKKIIIALCLGWVAIWIYRTILTPIYPQIQESLGNISDTQIGLVASIYFFAYTGMQIPSGALVDKFGQKKVLIPAFIVFALATFVIGTSSTIMQVYIGSLLAGISTGSYYGAAFSLSAKHTPKDKKSFSNAIINSGSALGMVIGLIGSSVLVGGFEIQWNYMLFITAIVIVAVTFVFVLFIKQDKTSDKEVAEEKKDTVQSTDIQNESLFSPRQLVVYFVYFATCYGYYMIVTWLPSFLVAEKGFAQGSVGYVAALVAVTAVPGALIFTKYIDKNAHLRLRLILFLLIAAAVTISLTVFAPNPAVLYIALILYGLLGKLAIDPVLITYVSDSVSGDRVARALTLFNFFGMSSSVIAPTLTGYIGDVTGSRVLAFYIATILLAAAALLFFLVVMLRQNKTAAN

SEQ ID NO: 5243 - protein, 537 aa, Bacillus licheniformis
MTTLKEILSVLQFSDLTLLNEQGDLERVVEMVDITETPDIKNFTTPHSLIVTTGMSYQDDQSGLINLIRELNDIQVAGLGIKLSRFLKKLDDEVIAFANKLKFPIIEIPESWNLGSITHHISSFILDEETEKLHFALDIQQELNAMLMQGFSLNMMIERLSRLIKVPVMLLNSFHQVESSSHHFHQNSEHVQKNLNYFRRYLNSEQTEPNHNGVFQEEYAVFKVPAFKYFPYYLMISNVNLLNYPISLLTIEQAVNTLSLAIYKNSKIKEAEQQDVNHFFTTLMSEHPDNLVSLAQHTDLLKKYHIQPSTFYQVIICGIDKEKNVENSAYLNERYQMTFEWLTHKFTGIDPSISIYMSQGERRFTILLQRRHHYYLEYCRYIQKEYQLFFNSSLSFGIGNEVSELSQLPLSFFEANEAYDNKYEQGEMEFIEPYKSKSVEELLQLIPTNKLKPFIIYTLGPLAYPQTTKEKELRFTLSVYMANQCDLTKTSEDIFIHRNTVKYRIKKCEEILGQSVESPDTSLSIRLALFASEKISL

SEQ ID NO: 5244 - protein, 454 aa, Bacillus licheniformis
MNFDSIIKNGLVILENGEQEVEVGIKDGKIAAIGQDLGTSAKIIDAKGSIVSPGMIDAHVHITEPGGGYRDEWEGYDTGTRAAAKGGVTTFIEMPLNQVPATVDEESIQEKFKAGKGKLSVDVASYGGLVPFDLDGGIQELDSNGVVAYKCFLATCGDRSIEGDFMNVDDYSLYEGMKQIAKTGKILSIHAENAAITDKLGEIASKNGETSLRAYVDSRPVFTEVEPIRKIILFAKETGCRVHIVHIACEEGVDEIVKAQQEGVDITCETCTHYLYFYKEELDHIGPVVKCSPPIREQSRLEGMWNRVLNGDISFVTSDHSPCTPDLKATDNAFEAWGGIAGLQNNVDVLFDEGVQKRNMPLSKFAAIIATNPAKRFNLASKGSIAVGKDADFVFIKKDAPYELKAEDLAYRHKISPYIGRKIGAQVVKTILRGVEIYDKEKGISNEKVGRFIP

SEQ ID NO: 5245 - protein, 400 aa, Bacillus licheniformis
MDKKFTSFGGLEQGGITRLLYSPEWIAAVRELEATFKEEGLEVSFDDVGNLSGRLVGSKHPEETILTGSHIDTVVEGGHLDGQFGILSALVAVKYLKEKHGQPLRTIEVLSLAEEEGSRFPYTFWGSKNFFNLAKKSDVETIEDADGIKFEDAMHESGFDYRKTDHVRDDIKAFVEVHIEQGKVLEAENKAIGVVTGIVGQKRYTINLKGEANHAGTTPMSLRRDTVVAYSEIVTDLTKRAREIGEPLVLTFGHVTPVPNTVNVVPGEITFSIDCRHIDQQLLNNFAKEIEDKVKAVAEANNMTYDINLWMDEAPSLMDKEIIKIIEQAAKANVGDSYKLMPSGAGHDAQIFADFVPTAMLFVPSIGGISHNTNEETKIEDLVKGIEVLKDVLFELAYKE

SEQ ID NO: 5246 - protein, 262 aa, Bacillus licheniformis
MSYLNHNQGYREGLLETRSVIKKDNYAVITPDGLVNNVVPGFEDCDVTILGSPRLGARFVDYLVTVKNKGGNKTGFAGDGIQSFVYVEYGKINAFADGEKYELAKGGFLYVPPHLQLTFENNNNGEDSRLFLYKKRYQPLEGHTPEIVAGNVNNIKQEAYEGMKEVLIQDLLPKEIAYDMNIHILSFEPGASHGYIETHVQEHGAYILSGRGVYNLDNEWMPVDKGDYIFMGAYTPQATYAIGLDEPFSYIYSKDANRDINL

SEQ ID NO: 5247 - protein, 342 aa, Bacillus licheniformis
MSEPLVYVERNRLRQLMKDKLVKAGLPEEQADKTADLLIFADERGVHSHGAVRMQYYSERALKGGYNLKPNLSFEKTGPASGIYHGDNALGHYVSYQAMKKAIELAKTSGIGVVGVKEMGHSGAIGYYAHQAALEGMAALTVCQSDPMVVPFGGTEPYFGTNSIAFSAPRKDGSPILFDMATTVQAWGKILDARSKNKSIPDSWAVDKNGAPTTDPFKVNALLPMAGPKGYGLAMMVDILSGSLLGLPFGKHVTSMYKDLSEYRRLGQLHLVINPEYFGGKEQFLEKISQMVEELHDNPPAEGFNKVYYPGEIQIDVMKQYKKTGIPVTKEILDYLESDKIY

SEQ ID NO: 5248 - protein, 349 aa, Bacillus licheniformis
MRVSKQELFHLIKQKLIKAGLNEGAAHDVSDVLTFADHRGIHSHGAVRVEYYAERIAKGGITANPNYTFEQTGPASAVFSGDNGPGHQAAKQAMEKAIEMAKNSGVAVVGMKNISHSGALGYFVEMAAEQDMVALSMCQSDPMVVPFGGTEPYFGTNPIAFSAPSADERMITFDMATTVQAWGKVLDARSKNESIPETWAVDAAGAPTTNARDVHALVPIAGPKGYGLMMMVDVLSGSLLGVPHGVHVSSMYQDLTKGRDLGQIHIVINPAYFTDLTAFKQQISTMLDELKAQPAAEGYGEIYYPGERGKLRSAKYDKEGIEIVDDIYNYLVSGDVHYNRYHGKNRFAE

SEQ ID NO: 5249 - protein, 585 aa, Bacillus licheniformis
MLYTIIKENTYQDSIVLMLLSNKLSAIDGINKVSIMMGTPANKDIFKSSGLGTDELEKANPNDIVIVIDTNQEEKVSEVKEEVEAALKGDSASQDRAKDQEAHNWKRAMELANNPNLALISIPGQYAAMEAENALNEGLHVFLFSDNVSKEDEVKLKQKAHEKGLLVMGPDCGTGIIHGVPLAFTNIVNKGDIGVVGASGTGIQEVTCIIDRLGKGVTNAIGTGGRDLSTEVGATMVLDSIKALNQDPQVKVITVISKPPAKEVQQKVLNVLRNIEKPVVTLFLGDKPTYQEENIYHAYTLEEAAVVSVQLSNGDKPNFKPTVAENVNVSLKDSQVGIKGYYSGGTLASEAAVLVKEAFKEEVPEEKKGAYILKTKHHEIIDLGDDIYTQGKPHPMIDPEKRIEMLETSGNDPETAVIMIDNVIGYGSHDDMANELAPAIKRILANAHQDGRELAVLVTVVGTDKDPQGYEKQIETLKESGAMICETNDQMVRTAIKLAGGKVEQPVLDIQKFEYTQEDLTVDEKIMSLINTKPSVINIGLKSFTAAVQKSGSECVQFNWRPIAGGDEKLMKVLQYLNYYEGETI

SEQ ID NO: 5250 - protein, 421 aa, Bacillus licheniformis
MGYKTINEANEAVIRKIIAAEPFLTDVVPAKSVIPELEDYVLLHAGPPIKYENMTDPMQGSCVGAILFEGWAEDEEGARGLLENNKITFIPCHHVNAVGPMGGITSPNMPVLVVMNKESGNEAYCQMNEGIGAVLRFGAYHEQVINRLHWMKDVLGPVLSKALRKIDGGINVNVLMAKAIAMGDEFHQRNIAASLVFLKEVAPVIVALDDVENEQSAEVIQFLADTDQFFLNIAMATGKAIMDAARTIKHGTVVTAMCRNGENFGIRIAGMGDEWFTAPVNTPQGLYFTGYSAEDANTDIGDSAITETIGVGGVAMIAAPAVTRFVGTGGFNDALETSNQMAEICVGENPNFVIPTWDFKGACLGIDARKVVETGITPVINTGIAHKIAGYGQIGAGTVHPPIECFEKAITAYAEKLGFQG

SEQ ID NO: 5251 - protein, 256 aa, Bacillus licheniformis
MILQASAVGSIALQLLIEGKTFTVHSIFEKGLNIVDRNDELIFIGTNENGTFPFGILLDSQTKQTLKADLEVGDTFHVRNSHLSHNCFELNFNAEILPLYTDFKHANINKLKENVKQISFKSYESTDFESARVSDLINKLHDPTENLEEELRYFIGRGQGLTPTGDDILVGILYGHFINSFIAEKHLETLGSLIREPLTTLVSTRFLTCAIEGLFSSKITKLQHDSSLKSIKSLIKVGSSSGMDTLYGIYMALTKE

SEQ ID NO: 5252 - protein, 310 aa, Bacillus licheniformis
MGKSVVIALGGNAILQPKQEATYANQFKNVISATRHMIEIKEAGHKIVITHGNGPQVGNIIAQNEAAKNVVEPLPIYACNAESQGFIGYMLEKALKNHIKKRGITANVATFLTMVEVDKYDKAFEKPTKPIGVFYSEEEAKKLEKKGFAMSEDAGRGYRRVVPSPEPKVIHGIEEIRRLIDETIVISSGGGGIPVYRDDSGLLHGLEAVIDKDRSGLKLAQQLNADVFMMLTDVPNVFINFGKENEQKLSRITVEEAEQYVAEGQFPAGSMLPKMQAAIEFAKLGKEAIICSLNQAAAALDGKAGTRITK

SEQ ID NO: 5253 - protein, 417 aa, Bacillus licheniformis
MTKEAGSVEGKGKQPLVPYWVKVVIVFFFGWVALYATRTILNPIMGDIESAFSLSKAQLGLIMSIFFIGYAGMNVPAGILGDKIGKKRVLVPGVILFGSLAAVTGMMPTFFLFISAWLMVGMAQGVYYGPQYGISSEIIPKNRLTLGSAVINAGMAFGTSIGYYISSYVVGEWGFGWGTPFFAIAVPVVLIGIAMAIVIKDKPKTDKEVKRSAEPFKFSSLFNRNLILAYIIIFCSIYGFFMIITWLPYYLETARGLTGGNIAFVASLVPWAAIPGSLFFSWLSDKLGRRKPVLLMMLPFGILSTAAIVYFDSLPILYMTLIVYGIVGKISVNPVLIAVVANNAPKQSLSTAFGFYNFVGMLGSILAPYITGWLTDTTGSMNIGFYFAAALLVIALIATYLIDESNLPSVDKAAKHH

SEQ ID NO: 5254 - protein, 112 aa, Bacillus licheniformis
MLSQIKYEETHSLQLRFKRHNKGDSQRLIDANNKQFGIVVLKFSSVCKTAWAKMTLDKAVSLGLEANAYLKRNTDGKELSCSPAGGKGKVLPGQTSCYTPMVDFDPRSSYAM

SEQ ID NO: 5255 - protein, 366 aa, Bacillus licheniformis
MNKIAAEEVANILNTWYRAIRRNDAEQSIRIFEEVKPMLAEMEEDQEVLIYYSLLELRHKIMLYDTRGKKIEQQEELTNGGSAASHMTSYYYYLFSGAYEVYKKNYEQAISFYKIAEKKLAHVHDEIEVAQFHDKVGKLYYYLGQNIVSLNHTRQAMEIFKGHGDHDMNLVSTYITMAGNYTEMGKYTEAEEYLTEAIHTVRKAGDCFKEMQLLHNFALLYAAMDNSEKSIQFLEIVLDDQAYAASDYYFNAVFLMIKELFKVGDHKRAAAFYKEGKERSKSAANKIFDAKIDILYAAYAGDGEQAVKDCKDNIEILFQTKQYDSARELSLLTANVYRSKSLYKEAAHFFLEAIKAEEKMKKVEGM

SEQ ID NO: 5256 - protein, 38 aa, Bacillus licheniformis
MKKLFIVAAIAAVVCSGWFAAETHWASGDMQVAEKMVG

SEQ ID NO: 5257 - protein, 9 aa, Bacillus licheniformis
DNEHFFTTI

SEQ ID NO: 5258 - protein, 175 aa, Bacillus licheniformis
MITLTATTLIISGFSGFASSVSAAEQEQSTTSITETTYVTLPASLQEYMETHQEPTTLEDSKAFIQFASQTPEFQTYNQLNQDGQVHTAGLIGGSLKAIKAFGWVCRVGGKTLKWAIRPLSPSKARLVDKYARKIAYATERLNSASKGALVKALVKAGVPKKTADSLAEIILWLV

SEQ ID NO: 5259 - protein, 345 aa, Bacillus licheniformis
MATIKEIALQAKVSSTTVSRVLNHDQSLSVAPETRQRILDIAARLGYKSTRRRREVYASGSGESPRIGIVVCQSQEEELNDPYFYSIRQGIESECFERGAFITKFIQLSSIRSNQPVGDVDGLIVIGRINFAGLQQCMGALNNVVYINHTDNEELRDSVVVDFEKATGRALNHLKSLGYTRIGYIGGREKEHFRISDQETSAIEIEDKRLTAFLEMAGSDNAKHIYIGEYSMQQGYELMKKALLEKNVPEAFFIASDSMAIGALRALRESGLKVPEDVAIVSFNGIEASEFANPPLTTVKVHTEEMGRTGVKLLLDRLKGRELPLKVTVPSELIIRESCGFSKRS

SEQ ID NO: 5260 - protein, 417 aa, Bacillus licheniformis
MKKIIFSFVLLIILSAILAGCSGKNAGKSGDVTLTMFSTMTNDSEKNTLRSIADDFEKENEGIKIDISFPGPDYENMLRVKMAANDMPDLFDTHGWAKIRYGEYTADLKDMDWVKHLDPNLDPILKDEKGKVYAYPFNQAKDGIVYNAGLLKKYGLKPPQTLDELMHALETIKEKSNGSVIPFWFAGSDKGALAQFYDQLATPLLITDDRRNEKKALENGTFDWSDYTLLAETFKEMQEKQLINKDILTAKPSQLVELMAQEKIGFTLSVTSIGPDTREVNPDIQLGVMPTPAVYEGDKPSWIGGERHTVAVWKDSEHLEEAKRFIEFAAQPKYVKKIAEATSFPQALTNTEAENYYSKFYDQYEEIKIEPYFDRVYLPSGMWDVMGTTGQELLAGTLTPKQVSEKMKQEYSRLQEQ

SEQ ID NO: 5261 - protein, 307 aa, Bacillus licheniformis
MSELAKEKSLTIVKSKRRYVRKNGSLWWMYLPALALVSVFMIYPFASGIKITFTNWNGFSQSYDWIGFAQYKRMLADPATWLVVKNTLLYGLGSTVFQNVIGLLYALLLFKSIKMKALTRTVVYLPVIISPLIMGYIWYFFFSYEGGALNDLLKLFGAGPVNALSSPEINPWIIVFVNSYQFVGIAMVIYLAGLGSVPKDFYEAAQIDGASGFQQFWKITLPLLMPSVTINMVINIIGGLKLFDVILALTGGGPGNASQSMSTFMYDLYFKRQDAGYAAAQGVFMAVLILLISFTALIYFKRKEVEA

SEQ ID NO: 5262 - protein, 276 aa, Bacillus licheniformis
MNRQEKKKRALWTLLAAWITVFHLIPFYILLTTALKAKGDFSSKWKFPDEISLGNFAEAWDKAGLAGSFFNTAVITFASAALLIVIGSLAAYPLARRRTKLNQAVYFLFIGIMIIPPLTSMVPLYKMVVELGMLNTLEIAILNNTAAYMPLTIFLYAGFIRSTIPKELEEAARIDGASTAGIFFRIVFPLLKPVTATICIIACVFIWNDYQFSIFFLQDKSVQTLTVAIAGFFGQNANNLHLVAAASLMAMLPMTILFLFLQKYFIKGLSAGALKG

SEQ ID NO: 5263 - protein, 432 aa, Bacillus licheniformis
MTKIAFIGAGSTIFAKNVLGDCLMVPAVNGFEFALYDIDPKRLKESKDMLEHLKNRYNDTVSIRAYDDRKEALAGAKYVINAIQVGGYKPGTVIDFEIPKKYGLKQTIADTVGIGGIFRALRTIPVLLDMAKDIESAAPDAWLLNYTNPMASLTGALLRYTDVKTVGLCHSVQVCTKDLFKSLGMKHERIEEKIAGINHMAWLLEVKQDGRDLYPEIKKRAKEKQKTKHGDMVRFELMDKFGYYVTESSEHNAEYHPYFIKSRYPELIEELNIPIDEYLRRCEKQIQNWEKMRGEIVGNRHLTHERSNEYGSRIIEAMETGQPFTFGGNVLNKGLITNLPEKAVVEVTCVAERNRITPCYAGELPEQLAALNRTNINTQLLTIEAATTKRKEHIYHAALLDPHTAAELSMDDIVSMCDELIEAHGDWLPEFE

SEQ ID NO: 5264 - protein, 372 aa, Bacillus licheniformis
MILISSFGGFLLSLTGMTIGWMVGTMTAAACLSLFRPSPLKAAVRQNGIHHGWLQFGQMLLGIELGQKINMSVISIFKENWLIVGVMLLLSVVFAMLSGFVLWRFSKTDMLTSFVGTAPGGLSAMPGIAQEVGANTAIVSLVQMIRVLLVVMTIPFFVFFINAKHPDAHAAGSQVMAAGTSAFEAPHIAWTALIVLGGFGVCKAMKALRFPAPWLLGSMTGAAVLQIAGASMTGLSTTAWWPHGFSVLSQICLGATIGSKISKDMFIGVRKTLIVALASSVGLIIAMILSAAVTAKAAGISLTTAILAFAPGGIAEMATTSVTLHADSTFVVAVQVLRVVLVIAMLPPFFRLLHQKSEKYTHPRVKKARVEG

SEQ ID NO: 5265 - protein, 77 aa, Bacillus licheniformis
MKHPKESFTKVKSYRPFHSAFDPCPPIGKRYYRTPPNLYLGFQPRGLPQFSPMEALQKGTLWPVFYDHYENPYEDGR

SEQ ID NO: 5266 - protein, 87 aa, Bacillus licheniformis
MTNSLPQDYYKRLHEIQAVDFVIVELMLYLDTHPDDTDAIKQYNQYAGFSRKLKAKFESKYGPLIQGSPDQTESYWSWKRSPWPWQV

SEQ ID NO: 5267 - protein, 189 aa, Bacillus licheniformis
MWLYEKKLQYPVRVRECNPRLAKFLIEQYGGADGELAAALRYLNQRYSIPDKVVGLLTDIGTEEFAHLEMIATMVYKLTKDATPEQMKEAGLGDHYADHDKALFYHNAAGVPFTATYIQAKGDPIADLYEDIAAEEKARATYQWLIDMSDDPDLNDGLAFLREREIVHSQRFREAVEILKEERDRKKVF

SEQ ID NO: 5268 - protein, 539 aa, Bacillus licheniformis
MVTLKKQTIGGLLKSTAGRFPNHEAVVYSELDLRYSYQELVEETSKIAKGLLALGIQKGEHVAIWASNIPEWILLQFATARIGAVLVTVNTSYQARELEYLLEHSDSTTLFLMDGYKGTSYINMIDEIMKNPEKLPKLKNLVYLGKNETPEHMTAFAEIAKMGETVSDADLFEREQSLTHDDVINMQYTSGTTGFPKGVMLTHYNIVNNAAIVADRMGLTSEDRLCIPVPLFHCFGCVLSTLACVASGAAMLPIIEFKPDIVLQTVEKERCTGLQGVPTMFIAELTHPDFANYDLSSLRTGIMAGSPCPREVMKKVMKQMNMTDITIAYGQTESSPVITQTTVTDTIERRVETVGKVHPHVEMKIVDPDTGETLGPDEQGELCTRGYLVMKGYYKMDEATKKAIDEDGWLHTGDLAEMDRDGYVRITGRLKDMIVRGGENIYPREIEEFLYEHEDIVDVQVVGVPDEKYGEKTAAFIKCRPGKKLTLEDVRDFCKGQLSYYKIPEYVFLIDEYPLTASGKVQKYVLRDRAAELLASPVQ

SEQ ID NO: 5269 - protein, 184 aa, Bacillus licheniformis
MFLSVPVSLFYAQLESNYRLYLETLFDDFLFTLTVYTVCRALLSITMQIPLVKWTEGLNIKTIVSISYVCYAVAAIGFAFSSSIFWLLSTAVLFTAAESMLLNHMQTFVSRLAPNHIRGGYFAFFGPHWDISRTIGPFLGGMIFIKFGGAALFLAIAGIMALGGIAQYRAVSRLKKLVLYSTWY

SEQ ID NO: 5270 - protein, 413 aa, Bacillus licheniformis
MKLRFGLLFVMLVFALPLAACQNSGSGNTGGHEEHHTKDHSEMKEKDADSLPSDFNKRAEEGLLVKNTKNSTRLDANTPEDMSIKTSQTIWPATHKQNRPGAVILVSGGSWQTALASADLIHHPNNGPVLIAEKGKISGQIQNEIKRLNPTGTSDGTQIMAVGEFDSKALQALNTFKIKELKGKNAADLAKEIDKEYAEAAGEYPKSVIIGSSEDDAELYSLPAVNWIAHMPEPILYVNKKGIPEETAEALKKRDAKANIYILGPKKAVSEKTENALKEYGTVKRISGDTPVANSIAFAKFRDKNTGFGWGITDPGHGLSFASTAAPELALAGAPFSHLGKHAPLLLLKNGQADSTLYSYLSEIEPSFHDRPQDGPYNHAFILGSENEISFRTQGILDGILEIKSADGGHSGH

SEQ ID NO: 5271 - protein, 455 aa, Bacillus licheniformis
MKKISFELAGSFFVLILFIEAVLFAALYTTIVNTRINEEISALQLRGNSHRDVLEKHFDKRTIDHVTLMETEARTNVIITDQNRRVLAQSAPGDMTEHLHFEEQNIPRNGTALSSHWNTSKYICTISPIMNGRETAGYVFMYLETSSIKALVASITKRFFLSFGLTGVLTVAAILWFSRVLAKPIIKLKEATESIKNGQASIPLDIKRNDELGELAASIESLSSNLSRLQKERNDFLSSVAHELRTPITYIKGYTDVAMRDKLEPQARNQYLSIIKEEADNLNTLVDDLFLLTKLKQPGFQINKKQVHLYTFVKKEIQKAAVAFSEKRISVSFDIPTDLYVTVDEVRFSQVISNLLNNARQYSDPESTAAVTASKLEDQVKITVADEGCGIPEEERDYIFERFYRIDKSRSRQTGGTGLGLAIVKEIVELHGGQIAAKNRTPKGSEFIITLPSDV

SEQ ID NO: 5272 - protein, 224 aa, Bacillus licheniformis
MNVLLVDDENRMLDLLELYLEHYSCTKAATGKEALDLIKMRNFDLVILDIMMPEMDGWTVCKEIRRLTSIPVIMLTAKNGQDDIVRGLNCGADDYLTKPFSEKVLLAKIEAVLRRTRRFHEIRFRGLIWNKQHHTLHVNHREISITPSEFDLLGTLLDHMDQVLSRDQLIENIWGFNSDIEPRTIDSHMRNLRHRLKKAGFPVEDHLRTVYGVGYKWTSKGTGA

SEQ ID NO: 5273 - protein, 149 aa, Bacillus licheniformis
MKNMWYVQPYHPAYPARQNNRLIKDLEKAVNGEHSAVVCYQKIAQKAPDAEAKQQILEIRQDEIRHFNAFLAFYTSLAGRKPDISITEPCPEQYWNALESALKDEQETVDFYLDIADYVKDRAIRDAFKRAAADEQNHAVWFLYFLSKR

SEQ ID NO: 5274 - protein, 264 aa, Bacillus licheniformis
MKKAILTVIAVLTSVVLFAGCQAEKGGSAKGQSEKVQITVSAAASLKDVLTELSSVYEKDHPNVSIKFNFGSSGALQQQIEQGAPADLFFSAAEDKFNRVVDQGLIDKKDSVKLVENSLVLIVPKGKSQHVNSFKDLADDKVEKIAIGKPESVPAGKYAKETLTNLDVWSKVQSKVVYSKDVRQVLSYIETGNADAGIVYRTDALSSDQVETVETAKSDLHTPIVYPLGIVKNTKHREQSEEFYQFLQSDQAVKAMEKYGFKKG

SEQ ID NO: 5275 - protein, 218 aa, Bacillus licheniformis
MLEEFLSPIEISIQVSAAAGIIAVLLGTAAARLLANRNFKGKSIIETVMMLPLVLPPTVVGFFLIVIFGRQSVIGRLIENVFQAPVIFTWWAAVIAAAVVAFPLMYQSAKSGFLAVDRDIEDAARVDGANEWRVFLFVTVPLASNGIMTGIVLSFARALGEFGATLMFAGIIPGVTQTVPTAIYLAIDSGNMTLAWMWVASIAIISFLMLFFVQFKQK

SEQ ID NO: 5276 - protein, 1166 aa, Bacillus licheniformis
MGAVFLSGRSGSGKTTFILNEIREKLRDEPLGKPIIFLVPDQMTFLMEYELSKTPDLGGTIRAQVYSFSRLAWRVLQHTGGMNRPFLTGTGIQMLLRRLIEEHKGEFKVYQNASDKSGFTEQVERMLTEFKRHCLPPQSIRDMMEGTGKSEYEDERILSDKLHDLYILYSKLEENLENQYVQSEDYLTLLAEQIPYAEEIRNAAVYVDGFHQFTPQEMSVLEQLMVHAEEITFSLTADKPFTANSPNDLHLFRMTGKAYYDLYQKAKELGLDPSEVRLEETKRHRHHPELQHLERYFDERPAKPYPGQTESLRIMQASNRRTEIEGIAREIHSLIRQGRFRLRDIAVIARNVEDYKDTIKEVFKDCELPFFIDGKESMQNHPLIELIRSTLDIIKGNWRYEAVFRCVKTELLFPEGQPKERLREQIDQLENYCIAYGIKGDRWTSKDPFVYRRYASLDEDFAKTDKEIETENMLNELKGWIVPPIHRLQKRLKKAETVREMAEAVYLYLEEADVPMKLEQERRLAEEGGRIAESRQHEQVWDAVIQLLDEFVEMMGTERISFALFQQMIETGLESLKFALIPPALDQVFIGNMDLSRMYGTKCTFLIGVNDGILPARPADDGVLSDEDREWLKRNGAQLAATGREQLLDENFLIYMTLSSPSEKLYVSYPIADSEGKTLLPSTVVKRLNELFPDSEEKMLIHEPEQLDDEAQLEFLVNKGIALSHLAGQLGIWTRQYAISDVWWSTYNFLMNEPDRIFSQNILSSLFFRNKVENLNRHVSRDLYGEHIQGSVSRMETFKACPFSHFASHGLKLKERQFFKLEAPDIGQLFHSALKLISDRLHELKLDWRDLTKAQCETLSSDAVERLAPKLQKEILLSSNRHHYVKQKLQKIIARVSGILSEHAKASGFAPVGIELGFGGKGPLPPMRFTLKNGCTMELVGRIDRVDKAESSKGLLLRIVDYKSSDKGLDLAEVYYGLALQMLTYLDLSITHSTDWLGMKASPAGVLYFHVHDPMIQASVPLGLDEIEKEIFKKFKMKGLLLGDQEAVKLMDTTLEQGRSNIISAGLKKDGSLRSDSDVVAEEDFHVLRRHIRRTFQQAGEEITDGKVSIEPYKLKDRTPCTYCSYRSFCQFDESLEENEYRILKPEKDSVILERLKKEDEADGDF

SEQ ID NO: 5277 - protein, 1230 aa, Bacillus licheniformis
MEISKPKGSTWTDDQWKAIVSSGRDILVAAAAGSGKTAVLVERIIRKITDQERPVDVDRLLVVTFTNASAAEMKHRIGEALEKELAENPGSLHLRRQLALLNKASISTLHSFCLQVIRKYYYLIDVDPAFRIADQTEGELLGDEVLDELFEEEYKKGNPAFFELVDRYTTDRHDLDLQHLVKRVYEFSRSHPDPEGWLHSLAELYDAASDTKVEALPFYSYIKEDIALVLEGMRQKLTRALDLTKQPGGPAPRAENFLDDLAQIDRLIQQQDDFSALHELVPTVSFQRLKPCKGDEYDPRLVDEAADLRNSAKKQLEKLKSDYFSRTPEQHLESLREMKPVIQTLVQLVLEYGRRFAEAKKEKAIVDFSDLEHDCLAILSVKNPAGEAVPSEAAKFYRHQFHEVLVDEYQDTNLVQEAILKLVAKEEHEGNLFMVGDVKQSIYRFRLAEPLLFLSKYKRFTDDGSGSGQKIDLNKNFRSRSDILDSTNFLFKQLMGEKVGEVEYDEQAELKLGASYPPNEATKTELLLIETPSGAPGEEAEELEAVQLEARAMAGQIRRLITEKFQVYDAKAKASRNIQYRDIVVLLRSMPWAPQIMDEFKQQGIPVYANLSTGYFEATEVSVTLSLLKIIDNAYQDIPLASVLRSPVVGLDENELSLIRIKDKKAPFYEAMKAYLAAADGDERLSEKLRRFDGLLKKWRAYAKNHSVAELIWEIYRDTKYLDYVGGMPGGKQRQANLRALYDRARSYEATSFRGLFRFLRFIERMQERGDDLGTARALSEQEDVVRLMTIHSSKGLEFPVVFTAGLGRNFNMMDLNKSYLLDKELGFGTKFIHPKWRISYPTLPLIAMKKKLRRELLSEELRVLYVALTRAKEKLYLVGTAKDKEKLLADWRTQAAGSEWLLPDYERFQAKSYLDFIGPALMRHRDMDESGAPPVIDEIREHPARFQVSWLSAADLQAEAVDQAGEERHDRLVQIQMGHAIEGAFEYEQQVRERLAWSYPYKDAAKVRTKQSVSEMKRQKEYEDEYGDRSLIRPSQEALLFKRPSFMMAKGLTAAERGTAMHTVMQHIPLTRTPEKNELSRLLDRLVEKELLTEDQRAAIEEDDILAFFDTEIGQKLFGARRVEREVPFNMTLSAKEVYPDLESADEPVLIQGIIDCLFETEDGFYLLDYKTDRIHGKYRNGFEGAEPILRKRYETQIQLYARAVETMIKMPLKGRALYFFDGGHVLLF

SEQ ID NO: 5278 - protein, 393 aa, Bacillus licheniformis
MRILHTADWHLGKTLEGRSRLKEQEDFLEELARIVKDEKIDAVIMAGDAFDTVNPPALAEQLFYESLSALSDKGNRPVVVIAGNHDNPDRLSAASPLTTDHGIHLIGYPRTAPVDIEVASSGEILSVAALAYPSESRLNEVLSETFDEKLLRDQYDEKIKQTFQRMCSKARKDAVQIAASHIYVAGGSQTDSERPIEVGGAYTVAAESLPENAAYVALGHLHRPQTIKRARTLARYSGSPLAYSFSEAGYAKSVTIVEAAPGQTASWEEVHLTSGKPLVKWKAEKGMSQVYSWLEEERDKNAWIDLEIHLTDQLSIEEIHRLRKARQGIIHIRPVFEEAASAEEKSRSRNVPIEERFKAFYERQTGGAVPDEETVKLFLELASGSEQEEGDET

SEQ ID NO: 5279 - protein, 1130 aa, Bacillus licheniformis
MKPISLSIKGLHSFRQEQVIDFERLCDAGVFGIFGPTGSGKSSILDAMTLALYGKVERAANNTHGILNHAEDELAVSFTFKLQTGHETAYKVERVFKRTDAVKVKTSICRFIEMKEEQIVLADKANEVNRKIEELLGLTIDDFTRAVVLPQGKFAEFLSLKGAERRQMLQRLFNLEQYGDRLVKKLKKQAQTAQSRKNEMLAEQAGLGDAGEEALKLAEQHLEEAETLLQSKRRERDAEAQRFAEYQEIWNLQQEKESYLKKEAELLKKKEQIREKESRLHLAETANTLKPYADAFLAAREDAERALREEKQAREQLEQYEELHKKTECEYENFRRHKNEKEPELLKQEEQLTALKEIENKRLAAQAEAEKKQREQRLKEEEIKHAADELAKVKSLLERGTAKQNQLKAELKSVQVSSEERKNCRKANQLAFHIQQLNSDAALEKKRLDQQEALIKELRQEQQAVDQKVKDETERIQALFAAVERAYALVCETDRSLSETVRLATQKKEEIVAKRKQANRDQLAIELAKQLKEGEPCPVCGSVHHEMPAGVGTESPSFKETESELEKTEAIIAEAGALAQEFLSAKVALEQQSGHLMSECPFLVKSKHELPETAASLEEGTIPERFSRISFEWKGIRQDLAETKSRMSKLLHTYKELCKKRDQISERLSHEEKEQNRLQNRVRELNDELNERQKSFGEQFGGLSYEQAEKWQKTIEEKDLAAEEFEKRIETSVEFLTEHEQQKEKLTERLFALDKEKLDLHYAVESLKKDINDYQKELTGYPDTAAIDEKLQDVKTQLAKLHEQEQTLYGRLKETESEVSRLRGQTKGCELALREAEARLAKAADIWQEKAGGTPFEKASEVKASILDRDELSRLKEDIQLYWDHTKQCESNIKRITEKLDGRSVSEENWEKAAVTKDQAEEAFSKALEERGAAGKALAVIRENHKRFKELETSLAEWQTYIDRLDKLQAVFKGNSFVEYLAEEQLESVTRDASARLGELTRQRYAIEVDSEGGFVMRDDANGGVKRPVTSLSGGETFLTSLALALALSAQIQLRGEYPLQFFFLDEGFGTLDQDLLDTVVTALEKLQSDNLSVGVISHVQELRARLPKKLIVHPAEPSGKGTAVSLEMI

SEQ ID NO: 5280 - protein, 72 aa, Bacillus licheniformis
MPAIVGPIKINEISGGVVNFGDSFYLSPKSTSKSALGSGAGNTGDFLIVNNGINATNYIDPDVSDQNVVGNA

SEQ ID NO: 5281 - protein, 128 aa, Bacillus licheniformis
MILRTSKVKFLKVHSVGISSTLQIGDTEEQFLKSKVLAVQRYLSLFYGNEGSFKQDDFQLFRQPIPQLLPETGVCSAFFHEIPFIRVRAIKINGVSSSSVAQVGSTRRINADSRVKHIRKLPPARNSQ

SEQ ID NO: 5282 - protein, 59 aa, Bacillus licheniformis
MNFTVVNRCFDVGNIVITGVSTSSVFLVGDTDCISLSSIFDTPPESLIVGPFVPLAPES

SEQ ID NO: 5283 - protein, 201 aa, Bacillus licheniformis
MKQSNPQNWYVYLQQQAAQIQRLESQIAVLHSELNQLKENPGTRIDRIEYKFDQLKIERLDGTLNIGLNPADPDNVENFEISQQPPGIGMLQQELDSQLMQQTRQLVDAYLNEETPRLLEQLEDRYDSKLDDTNRHHIIEDIRKQIDSRIRYYVKHVKPDGNIQPREHAERLADYVKRDIARAIEHFLKSIPDEMKGNENE

SEQ ID NO: 5284 - protein, 80 aa, Bacillus licheniformis
MNFYINQTIQINYLRVEGISNSSVLQIGSAGSIKTLANLYNTGSYTEPAPPVTGEVFDDAFGDGTQPTLVPLHAPSVTVP

SEQ ID NO: 5285 - protein, 73 aa, Bacillus licheniformis
MPAIVGAFKVNAVGTSGVVHVGDCITISPYAEVKTFAGAGSFNTGDGLRVYNQNSITNTYDNDVIDQPVAGNL

SEQ ID NO: 5286 - protein, 97 aa, Bacillus licheniformis
MYFQLNPISIAAALLFFAAAYAVGIKKQTWILRGFRRERVRDQVKLAKIAGYFFLNSGFLLFLNGVVYIPYQESFTPSAILAYGICTMIYVQKTMAE

SEQ ID NO: 5287 - protein, 60 aa, Bacillus licheniformis
MMNNKIEAKRLALFEAAEKFGINSKEAIRCSQELDNLLNQRMQKDDNCVHAEERKGRHTS

SEQ ID NO: 5288 - protein, 357 aa, Bacillus licheniformis
MSATALPAFRLHIHPKHLLELKKDVWSDEAVPGMLLTGSAKTPVAVSYRGAHTRKLTKKSYFIQYPDNKEKAAFHLNAEYHDPSFIRNRLSFHFFEQIGVLAPAASHVFLYINEKKEGIYLKIESVDDHFLKRRNLERGAIYYAVDDDANFSLLSSFNKKAKQNLMQGYERKTGSSRHDDYLHEFIYFINTAKDDIFEKEIKRYLDVKQYLLWLIGAVCTQNFDGFVHNYALYLNGRTKTFQIIPWDYDATWGRNIHGEEMEHNRIPAKGYNTLSARLLDIPAFQSQYFNLMKNVLHRQFTISRLSRYAVNWHETIAPFLEHDPYTTVTYSRLEDEQKQIFHFIDQRKRFLLFELSR

SEQ ID NO: 5289 - protein, 168 aa, Bacillus licheniformis
MSGVHDHDIKKAVDQLKSEGRDHYLDREPEEYAGSGKERRPHNIWDLWGGIKPDRSKKHHKSKKHDDYEKPDKSKKPDKSKKPDDCKKPDKSKKPDDCKKPDKSKKPDDCKKPDKSKKHHDCKKRDKCGRKRPDHHRCKKTHHHKRGGYETITKWSDGNLTEVIYRKK

SEQ ID NO: 5290 - protein, 301 aa, Bacillus licheniformis
MKFATAKLHSRTFVGLVMDEKIMDLQKAEKKLFELETIPETLIECVSEGEKFVRHVEQLVEWSKKKNSEESGSYIYPLSDVDLLAPIPEPRKNVICIGKNYRDHAIEMGSEADIPEHIMVFTKAPTSVIGHMEGIDAHEGVTEALDYEGELAVVIGKTGKNIPKAEALDYVFGYTIINDVTARDLQKRHKQFFIGKSLDATCPMGPFLVHKSMIEDPGDLKVETRVNGELRQSGSTKDMIFPIAEMIETLSKGMTLEAGDIIATGTPSGVGKGFNPPKFLRKGDQVDITIEPIGTLSNPVK

SEQ ID NO: 5291 - protein, 350 aa, Bacillus licheniformis
MNLSALGIKYIMEALKDEEGLVLGRIALEHKRLYRVWTEEGQWLAEISGRLRFEVESRGDYPAVGDWVYMRPRGGEKKGIITEVVPRFSKFSRKAAGEPAEEQITAANVNTIFLVNALGLDFNVRRIERYLLLAWESGANPVIVLSKADIADRIEEKVRQAESVAFGVPIHVISAHEGSGMDELKAYVKQGETVALLGSSGVGKSTIINFFLKEDRQAVQSVREDDDKGRHTTTHREMFMLPEGGLLIDTPGMRALELWESEEGFKQSFSDIDQLAQNCRFSDCLHQTEPGCSVREALADGRLDAGRFQSYLKLKKELEYLERKTDKRAMQQEKKRWKQITKSMKKNKNK

SEQ ID NO: 5292 - protein, 118 aa, Bacillus licheniformis
MTHMHITSWVIALILVFVAYGLYSSGNSKGAKITHMILRLFYIIVIITGAQLFLKFTAWNGEYIAKALLGLITIGFMEMLLIRRKNGKAATGIWIGFIVVLLLTVVLGLRLPLGFKVF

SEQ ID NO: 5293 - protein, 188 aa, Bacillus licheniformis
MDTERQKRLYAEKRKWIYGKILMEDGICLIENEEGDLLLVESLNSPGVFISIDGEWQKAELFDQFAVTEKPETVKLTGGEPIRYLKTVKQAFLEFLNDLEDGQFYSFLDQLNSLGFSVFDCVFAYNGLSFWPEKKDVKGVSFYQFSHDMKQCALQHHYERKEEWKDRFEWTASDGERIVMISTFKPPT

SEQ ID NO: 5294 - protein, 613 aa, Bacillus licheniformis
MCGITGWVDFKKPLVREQSIMEKMTDTLSKRGPDDTNIWGKRHVLFGHKRLAVVDLEGGRQPMTRTHQGYDYTICYNGELYNTEDLRKELRRRGHQFKSHSDTEVLLHSYMEWKEECIDRLNGIFAFAVWDEKRDLLFAARDRLGVKPFFYTEQGSSFLFGSEIKAILAHPEVKAKVDRSGLAEIFGLGPSRSPGSGVFKGVKEIRPGHAMIFSKDGLTVWRYWNVKSEKHTDSFDETVENVRSLFQDAVTRQLVSDVPVCTFLSGGVDSSAITATAAKHFEREGKAPLHTFSIDYEDNEQYFTSSSFQPNADGPWIKKMSDAFGTVHHNCVISQEELAAYLEEAVLVRDLPGMADVDSSLLWFCREIKKDFVVSLSGECADEIFGGYPWFHSAEDVKGFPWMRSMEERIGLLQDGWQKKLNLSEYVKAKYEETVKETPLLEGETGAEKRRRELFYLNMLWFMTTLLDRKDRMSMGASLEVRVPFADHRLVEYVWNIPWDVKMHGSREKGIFRKALEGILPDEVLYRKKSPYPKTHHPAYTKAVIRWLESLLEQKDSALYAFLEKKKLERLIETEGASFQVPWYGQLMKGPQLIAHLAQIHTWFESYRIDIEE

SEQ ID NO: 5295 - protein, 425 aa, Bacillus licheniformis
MTWVAIGTLLVFFMHAGFAMVESGFTRAKNTLNILMKNFLTISIGSILYFFAGYAFMFGDSAGGFIGTSGFALAGDQDVGFFVFQAVFAATCATIISGAVAERMKLGSYMILTLFMTGLIYPVVGHWTWGEGWLYDLGFVDFAGSSIVHLTGAAGAVAAVMFLGPRIGKYTNGKVNAIPGHSIPLGALGVFILWFGWFGFNGGSTLAADPAAVPHVITTTLLAASGGVVSSALFTYFRYGRIDPSLTLNGALGGLVGITAGADGVSFTGSILIGFIAGVILVVGVQFIDQVLKLDDPVGALAVHGICGVWGTLAVGLFNTSSGLFYGGGAAQLGIQAVGILSIAAWTLAATYAVAAAMKALAPIRVSKEEEISGLDYAEHGSSAYEYKESYIDQDDVDVSSAFGTDLVSRLNNLKPGPSSKTEQV

SEQ ID NO: 5296 - protein, 129 aa, Bacillus licheniformis
MKKIETIIRPEQFPRLRKKLEEVGINGLTVSEVAGCGQQRGKQALFRGTSYEIKLLPKVKVEMVIESESVDEIIKSKAHVRQIRSATEKSLSFQLKTRSESGQGNQERKRLSKTTDSLLLSFSRYFKKG

SEQ ID NO: 5297 - protein, 446 aa, Bacillus licheniformis
MKKTAPQNLSLFALTWPIFIEVSLYMLMGNADTLMLSQYSDDSVAAVGVSNQMLNLIIVMFGFIATGTTVIISQFLGARQKAEAMEVGYVSISANFIISLFISAAIYIFAKPLLLMMGLSANLLAEAGIFLQIVGGLSFVQALIMTFSAILKSYGYTKDTMVVTIGMNILNIAGNYLVIFGPFGFPVLGVAGVAMSTSIARIIGLLAIALLVKKRVGMPLLSKRLFVLKKSHLKKLLKIGIPSAGEQLSYNASQMIVTYFITLMGAQALTTKVYTQNLMMFIMLFGTAISQGTQILIGRHIGAKQFDEAYSRCLKSLWWALAITTFTSVLFAVFSKQLIGIFSSNPDIIATASILILLTIILEPGRSFNVVIINSLRAAGDAKYPVYMAIVSMWGIGLPIAYIFGIQLGFGLAGIWFSFIADEWVRGILMYRRWRSKMWLQKGFAA

SEQ ID NO: 5298 - protein, 287 aa, Bacillus licheniformis
MEHIIFTIPPLPVLITGGEGLFKRGEKHVRREYSVFDLLYVIQGELFLTEDGEPHQIREGEYIILIPGLEHYGHRGCQDDTRYFWLHFQEPSYGFAQQGGENWTELKLRKGTFETPTLYHLKIPRKGKIDQKAFIEQQFRRLIDDSAQNSDLPLRRQLLFEELLIHLQKEAFHIPSASERVASEAQHYIDRHYKEKLSMEQLSAALHYHQDYITRCMQKVFGITPGQYANKAKVFEAKRLLSSTNDKMSSIAEQVGIDDPTYFSKLFKQIEGISPVEYRKMMKRNIE

SEQ ID NO: 5299 - protein, 185 aa, Bacillus licheniformis
MASINGEKVKLRTITMDDLPGLWRMIYGTKNPEWKKWDAPYFPLQPEPFQYFIDSFVPALKEKPPRYLAIEIGGELKGTVSYYWESRPTRWLECGIGIYDPRFWNGGYGTEAVELWIGFLFENVDVPRIGMTTWSGNRRMMRCAEKAGFKMEGRIRKVRYYDGVYYDSIRYGILREEWELICRGS

SEQ ID NO: 5300 - protein, 347 aa, Bacillus licheniformis
MKKTIYDVAEAAGVSISTVSRVINNTGRISRSTRQRVHAVMKELDYQPNVHASALTGKRTNIIGLLTPDIANPFFGELAKSVEERAGELGFSIMMCSTDRDPKKETTYFSVLKQKSVDGIIFATGIENQETMDALEDIAKEGIPLVMISQDRALVPMDVVVIDDFMGGYLATRHLISLGHKTIACIAGDGSTTGEKDRLKGFKKAMDEAGIKADETLIAGSGFSLECGKKAAAQIFKSNIPTAVFAMNDVLACGVIQTAREWGLHVPTDLSVIGFDNTFLAEMTDPPLTTVSQPIEEMGRRAAELLAEEISGKKSSKSKIILTPELVVRQSTAPPFKKEAHAEKSGF

SEQ ID NO: 5301 - protein, 342 aa, Bacillus licheniformis
MTEVVRCAVLGLGRLGYYHAKNLKTEVPGVLLAAVADPAEGSAREVAAELGVEKWFEDPFECLRDPEIDAVVIVTPTSTHAEMIKQAAEFGKQIFVEKPLTLNLEESIEVISKVKEMGVICQVGFMRRFDPAYADAKRRIDAGEIGKPIYYKGFTRDFGSPPAEFIKKSGGIFVDCSIHDYDIARYLMGAEITAVSGHGRVLKHAFMPGCHDVDQALTYMEFDSGAAGDAEASRNSSYGHDIRAEIIGTDGSIFIGMLRNPAVTVRTGKGSSYNIIPDFQARFHEAYCLELQHFADCVRIKTKPLVTEVDAAVNLEIALAATQSWSTGRPVKIQYQTKKLTV

SEQ ID NO: 5302 - protein, 247 aa, Bacillus licheniformis
MDAGGLDPSVIPAVKKRHGADLLYTIPSFHNPTGKLMSEDRKRELIQISKQLSLPVIEDDAYGDLQLDGPPSSPLKAMDREGSILYVGTLSKTVSPGLRIGWVAGPEPVIERLADIKMQTDYGSSSLSQWAAAKWLSSGLYDENLSRIKVELRQRRDEALRCLETYCRGIARWEKPSGGFYIWVTFLKPLSLSALFEQALQKNILINPGTLYDKEAKYSIRLSYSYASLTELRYGIQTIAELAGKLM

SEQ ID NO: 5303 - protein, 448 aa, Bacillus licheniformis
MPVQTSSKNQVFLEQQNRRESNARSYPRRFPLAMQTAEGVLVTDADGKQYYDCLAGAGTLALGHNHPVVIEAIQKMIEEKRPLHTLDITSEIKEEFVNEVFASLPEAFAKRAKIQFCGPTGGDAIEAALKLVKTATGKRTILSFHGAYHGATHGTMALSGNLSPKENVQGLMPDVHFLPYPYEYRCPFGKGGEASHKLSSAYIENMLDDPESGVLQPAGMIFEAVQGEGGSVPARAEWIREMRRITKERGIPLIIDEVQTGIGRTGKMFAFEHAGIIPDVIVLSKAIGGSLPLSVVIYDQDLDQWGPGAHIGTFRGNQMAMAAGSATLKYIKEHDVLSHVEKVGAKLMRELQDIQEHVPEIGDVRGRGLMIGAEIVAPHKKQNANGSYPADAELASTIQRKCFEKGLIVETGGRHGSVIRFLPPLIVTEAQIDDIITIFREAVYEAVK

SEQ ID NO: 5304 - protein, 503 aa, Bacillus licheniformis
MKQSSKQKNFDSLFMHNGEQGIKAYRDAVETAVETLWADWKNKSKPYSGKMPKELDLEIKSLFSFQEAGESLADVLEHLKEAYLPHRIHVEDPKCAAHLHCPPLIPALAAEMLISVLNQSMDSFDQSGAASLIEEEMVQWLCRKFEYGKDADGTFTSGGTQSNYMGLLLARDAFCEKQWNWNVQKDGLPPEANRLRILCSKDAHFTVKKSASQLGLGERAVVLVDTDAEKRMSLYDLKQKTAMLKESGLHPFAIVATCGTTDFGSIDPLSELADAAHAGGLWFHVDAAYGGALILSRTRRYKLAGIDRADSISVDFHKQFYQPVSCGAFLVKDRRHFRLIDYHADYLNPEEDEAEGIVHLVNKSIQTTRRFDALKLFVSLRVLGEDTFAEMIDWTFALAEAAAEKISASDRFELLNPHPELNAVVFRCLASEDDAENDRLNKCIHRELFRTGQAVIAKTAAAGKTYLKFTLLNPRTTLSDLDDILGRIQELASLYTNSRRVTG

SEQ ID NO: 5305 - protein, 588 aa, Bacillus licheniformis
MSSFKEIAENATIQSFLNCYLRETGIETREIADGSQKTLIVPLERQQIELIVPIKYWSKTGRHLFSFPLYYQTAQNGKPLPLDYVTLVSLASKELLLQQSRGGAEDEFMLRVILSCRNISRYVEERADDQSELSRADFTFIEAEQSLLLGHLMHPTPKSRQGMKPEEESIYSPELKGEFQLHYFKAHASLVLHDSSTGTKAPLVIQEELRNDPMIDNAWLDEQTADPDFALLPAHPLQARALLEEPYVQKLIAQGLLTYLGAKGRKYTATSSVRTVYSKHSRYMYKFSVPIKITNSLRVNKQKELDRGVEMARLLQTELGQRLKQEFPGFRVITDPAYISIRGENGESGFEVVIRENPFYEDDRSACLIAGLCQDHAYGKESRLCSVIRGLALEEGRTTEEVSIDWFDKYLSISLEPVLWLFETYGLAIEAHQQNAVIRLKNGYPETFYYRDNQGYYYSESKAGILSKLIEGLSERSETICSDSVAVERLRYYFFFNHLFGLVNGFGCEGLIGEETLLSMIRERLEKAEQIYGITELTDSLLRFAELPCKANLLTRFYDMDELTGSLETQSRYTSVNNPLLKEAAAVQ

SEQ ID NO: 5306 - protein, 184 aa, Bacillus licheniformis
MNERITFQKADYERDISLVYRWMQEEHVIPFWHLNMPFAKFEAHFHKAITDPHQTLYIGFIDGVPMSYWESYWVKGDIIEHHYDNEPFDQGIHLLIGEKAYLGKGLALPLLKAMVNMQFAVPETKKVIAEPDIRNKKMIHVFEKCGFRPIKPVNLPDKTGLLMFCERERFFEKEKKDELYKETQ

SEQ ID NO: 5307 - protein, 447 aa, Bacillus licheniformis
MNSTKRPNDVYDVIGVGIGPFNLGLAALADSVPEINALFFERNESFNWHPGMLIEGTTLQVPFLADLVSMADVTSKYSFLNYLQQHNRLYSFYFLEDFHIPRQEYNHYCRWVAEQLDPCRFGMNVESISLVESNPEALFKVRVANRENGGEAVYYTRHIALGIGTGPHVPDALSDALGGSVFHSAEYLKRKPGGFKGKRVAVVGSGQSAAEVFYDLVGEDEAEHVSWLTRSKGFFPMEYSNLGLEYFSPDYIDFFYQLPQWKKDELLTQQDLLYKGISAKTISDIYHILYERTCGGRKAAFDLQSMTEVEQIEQRGETLVLYCTNRVNEDRFERQADVVVLATGYKERLPECLAPVDSLIEKDASGRYVITRDYRLVTAAKSKNHIFIQNGELHTHGVGAPDLGLGAYRNSVIINQLAGREVYTVSHKTVFQTFGTGIAEKTAVPNG

SEQ ID NO: 5308 - protein, 604 aa, Bacillus licheniformis
MLFQDELKRVLDPDRWREVNRRLLAKMLSEYMYEDIIKPDFIETEDGINRYELRTAEDKVYRFAAKPRMFDSFDAVPETIEVFKGGQWTKHVSAIEFLLDIQPHIPMSPETAGHLIKEFNHTMLADAHLLAKDALTADELTEADYAVIEGEMTGHPWIVYNKGRIGFGYDDYLRFAPENQRAKRLLWIAVHKDTASFHSVEGLDYETLIHKELDELTLRQFAKVIEKQGAASEDYYYMPVHEWQWTNTIIQQFPEEIASKAIIPLGEGGDEYLPQQSIRTFTNITNKHKHHIKLPMSILNTLVYRGLPSERTVIAPKITEHIKGIAENDAFLKDECRVILPGENASLNVDHQYYHSLEKAPYQYLEMLGAIFRESIYTYLEEGERPVTLASLTYIDQGGVPFIRRLIEKSGLSAEEWIGKLFDTVMPPLLHFMYRYGTVFSPHGQNTILVLKDHQPHRLAIKDFVDDVNISDQPLPELSGLTGDLKAVLRSEPPEGLVQFIFTGLFICHLRYVANILENDGLLPEKRLWKALADAILDYQQKFPELRERFELFDLFKPELTKLCLNRNRMVDYGYKDGDDRPHASEFGKVTNALAKFKKEAAKL

SEQ ID NO: 5309 - protein, 146 aa, Bacillus licheniformis
MIEVKPINAEDTYEIRHRILRPNQPLEACMYETDLLGGAFHLGGYYRGKLISIASFHKAEHSELEGEEQYQLRGMATLEGYREQKAGSTLIRHAEELLRKKGADLLWCNARTSVSGYYEKLGFSEQGEVYDIPPIGPHILMYKKLT

SEQ ID NO: 5310 - protein, 277 aa, Bacillus licheniformis
MKPLKGKIALVTGGSRGAGRAIAAELGKAGATVYITGRSIRGASTNQWPGTIDDTVSQIEASGGKAIAVRCDHTNDAETEAVIAKIREEQGKLDILINNVWGAHDLGVEAKPFWELSLKNWDTMFAAGVRAQLATNHFAVPLLRENKQALIIHTTFWDENKYTGQFYYDLAKNAIVRMAYGLSLELKRDNIAVIAVSPGFMRTELVLKYHESDEAHWRESEDLRRTETPYYVGRGITALAKDPDVMEKSGRALRVGDLAKEYQFTDVDGRYIPPFTI

SEQ ID NO: 5311 - protein, 320 aa, Bacillus licheniformis
MRGDRLISILLMLQAQGQMTAKELAERLEVSERTIYRDMEALSGAGIPVVAERGINGGWSLLDDYQTTLTGLKESEIRALFVPLSEQLLDDLGLTRISEEARNKLIASLPSEYRQNAKDVWNRIYIDTCSWRHKKEKAESFEVLKDAIWKDQKLKIVYQRADGQTADRVVAPLGLVAKGANWYLIASKENGEIRNYRASRIKSAVFVRETFDRPENFDIAHVWRSSTKEFIERLPTYEVRVKAAQAILPRLSFTNHFVRIIETNEIDQEGWIPVTLSFDTEEEAKRYILGFAEHMRIIEPKELHGKILKMAESIVAHYKT

SEQ ID NO: 5312 - protein, 1138 aa, Bacillus licheniformis
MSNINDQLKKKILVLDGAMGTMIQDAGLSAADFGGEAYEGCNEFLSITAPHVIQGIHEAYLEAKADIIETNTFGATRLVLDEYDLGHRAYEVNLASVKLAKAAAEKFSTPEWPRFVAGAMGPTTKTLSVTGGTTFDELIDNYEEQARALITGGADLLLLETSQDMLNVKAGFIGIRQAFEKTGKTLPLMVSGTIEPMGTTLAGQDIESFYISLEHMKPVSVGLNCATGPEFMTDHIRTLSSLARTAVSCYPNAGLPDEEGQYHESPQSLAKKIKAFAEEGWLNIVGGCCGTTPAHIEALADEVALLPPRTVPSGAKPHTVSGIDGLIYEETMRPLFVGERTNVIGSRKFKRLIAEHKFEEASEIARAQVKNGAHVIDICLADPDRDEAEDMEGFLKKAMKKVKAPFVIDSTDKTVIEKALKYSQGKAIINSINLEDGEERFADILPLVKQFGGALVVGTIDEEGMAVTAAKKLAVAVRSHQLLTEKYGIPASDIIFDPLVFPVGTGDEQYIGSAKETIEGIRLIKEQLPECLTILGVSNVSFGLPPVGREILNAVFLYHATQAGLDYAIVNTEKLERFASIPKEEVEMAEKLLFHTDDKTLASFTDFYRGKKKADKQPKTSLSLEERLAEYVIEGTKEGLIPDLEQALKKFATPLDVVNGPLMDGMAEVGRLFNNNELIVAEVLQSAEVMKAAVSFLEQYMEKKDDSGKGKIILATVKGDVHDIGKNLVDIILSNNGYKVVDLGIKVTPQELIEAIRKENPDIIGLSGLLVKSAQQMVVTAKDLDKADISIPIMVGGAALSRKFTNMKISPEYKGPVLYAKDAMDGLSLANQLRTDPSQFLEKKEAAAPAAVAEKKQTKAVIEMLEKRAHVPKAPVFQPEDLKRHYLKNIDLSYIVPYVNEQMLLGHHLGLKGKVKKLLAEQHPKALELKELIDELLRDGKEHGWFDPAVVYQFFPAYSDGDSLHILDPVNKDSILETFVFPRQEKLPYRCISDYVRPKGELDYVSFFAVTAGRHVRAAANRFKEEGDYLKSHAVQALALELAEGLAERTHQVIRDRWGFPDAPDFTMEQRFQAKYQGQRYSFGYPACPNLEDQEKLFRLIQPEGIGVHLTDGFMMEPEASVSAIVVSHPEARYFNVH

SEQ ID NO: 5313 - protein, 609 aa, Bacillus licheniformis
MGFLEDIKNKTLIADGAMGTLLYSYGIDRCFEELNISKPEEIRRVHEAYVQAGADIIQTNTYGANFIKLSRYGLEDETKQINEKAVRLARAAAGSAYVLGTLGGIRTFNKNSYSLEDIKRSFREQLYLLLNEQPDGLLLETYYDLEEAREVLKIARKETELPIILNVSMHEEGVLQDGTPLADGLKQLASLGADVVGINCRLGPYHMIRALEEVPLLEDAYLSVYPNSSLPSLVEGRLVYETDDEYFRESAEEFRNQGARIIGGCCGTTPNHIRAMAEAVKGLPPVTEKRVKIRKKAALAVQNERTEPALDDLAKQKRSIIVELDPPKQLNFEKFLHAAEELKSAGIDALTLADNSLATPRISNVACGALLKQRLDMRSLIHITCRDRNLIGLQSHLMGLDTLGLSDVLAITGDPSKIGDFPGATSVYDLTSFDLISLIKQFNEGLSYSGKPLGKKTNFSVAAAFNPNVRHIDKAVKRLEKKIACGADYFISQPVYSEEQLIKIHKETRHLETPIYIGVMPLTSSRNAEFIHNEIPGIKLSDSIREKMALAGNDKQKQAEEGLAIARSLLDAACDLFNGIYLITPFLRSDLTAELTAYIHQKEKEKTNV

SEQ ID NO: 5314 - protein, 163 aa, Bacillus licheniformis
MAKESSFDIVSKVELPEVQNAIQTALKEIGTRYDFKGSKSSITLEGDELVLVSDDEFKMNQLKDVLVGKLIKRNVPTKNIEYSKLENASGGTVRQRGKLVQGIDKENAKKINNLIKKSGLKVKSQVQDDQVRVTGKNKDDLQQIIAMVREADLPIDVQFINFR

SEQ ID NO: 5315 - protein, 284 aa, Bacillus licheniformis
MKPGQQLTLKIDHKADYGYFLTDGETAVLLHQSEITEDIDGREEVDVFLYVDHEDRLAATMRKPIISAEQYGWVEVVDAVSGMGVFVDVGLSKDALVATEHLPPYESVWPQKGDRLYCMLKITGHGRMFAKPAPEDKISELFTEASPGLMNKELTGTIYRLIASGSFMISEAGIRGFIHSSERKEEPRLGEKLTARVIKVKEDGSVNLSLLPRKQDALSVDAEQILTYMRSRNGAMPFWDKSDPEDIRERFNMSKAAFKRALGHLMKQDKIYQEEGWTYEKKLS

SEQ ID NO: 5316 - protein, 70 aa, Bacillus licheniformis
MSVLFGEPVFLLVDGVIVNRLFIIIFHEEAPPVKMSLLACSLPAKLCTLPIAMFFAGKFMPPCSVSIHIS

SEQ ID NO: 5317 - protein, 65 aa, Bacillus licheniformis
MLLSYIHRVSAGGVVNFGGAYKICPITMEKVVEGSGGPDVATAAAGFLDGALAPAVEEGTVTEDS

SEQ ID NO: 5318 - protein, 286 aa, Bacillus licheniformis
MNVHLLADSAADLPKSFYDEHRISFIPLRVLLDEKEYDDLLTIQPLDVYEAMREGKAPKTSQPSLMLFKNAFSELANENKPALYIAFSSELSGTYQTAVMAANEVKEEFPDFDLRIIDSKCASLGYGLAVKHALKLATNGNTIQEIESSVKDFCEHLEHIFTVDDLTYLARGGRISKASAFVGGLLNIKPLLHVDDGKLVPLEKIRGKKKLLRRMIELMKERSVDLSGQTVGISHGDDEETAEEVKRMIEAEFQPEEIVVNMIGSAVGAHAGPGTLAVFFPGKDKR

SEQ ID NO: 5319 - protein, 280 aa, Bacillus licheniformis
MVIAEAKKLFIVIIGALLNAIGLNLFLIPADVYASGFTGVAQLLSSALDQYSPIYFSTGTLLFILNIPVGILGWLKVGRSFTVYSILSVALTTVFLGMLPEASLSNDILLNAVFGGVIAAVGIGLTLKYGASTGGLDIIAMILAKWKDKPVGTYFFILNGAIILTAGLLNGWEKALYTLVTLYVTTRVIDAIHTRHAKLTVMIVTKKAEEIKEAIYGRMVRGITTVPAKGAFTNEQKEMMIIVITRYELYDLEKIINEVDPKAFTNVVQTTQVLGFFRKD

SEQ ID NO: 5320 - protein, 150 aa, Bacillus licheniformis
MRLISMIVMLLFVSGCGQNGDQVPDKEVSGEVDNGSVTLTVEPVQKQGEIEFRMSVVNHTDDAAEFEFSSGQKFELIVSDKEGNERYRYSKGKMFTQAFQTMTLNPKESYDFTDVWKEVPEPGTYEVNVTFLGRSEQFATLRAGKTFEVK

SEQ ID NO: 5321 - protein, 326 aa, Bacillus licheniformis
MENVFDYEDIQLIPAKCIVKSRSECDTSVQFGGRTFKLPVVPANMQTIIDEKLAVSLAENGYFYVMHRFEPETRIDFIKDMKARGLFSSISVGVKDEEYAFIEELTRENLTPEYITIDIAHGHSNAVINMIQHIKKHLPDSFVIAGNVGTPEAVRELENAGADATKVGIGPGKVCITKIKTGFGTGGWQLAALRWCAKAASKPIIADGGIRTHGDIAKSVRFGATMVMIGSLFAGHEESPGATIEKDGKLYKEYFGSASEYQKGEKKNVEGKKMYVEHKGAIMDTLTEMEQDLQSSISYAGGNKLDAIRNVDYVIVKNSIFNGDQY

SEQ ID NO: 5322 - protein, 55 aa, Bacillus licheniformis
MAKAAVHAAEASADSGEKAKAVARAKNALSSAYANSTDAERRQLHNLQEQLDQLS

SEQ ID NO: 5323 - protein, 63 aa, Bacillus licheniformis
MRRRPHRTVTCVKGEFKMGKRSKSKRFIQQGKDSLKQHAARFPYRSTLEEAEQKSGPTECGGL

SEQ ID NO: 5324 - protein, 270 aa, Bacillus licheniformis
METKPYLIALDLDGTLLKDDKTISESSSEVIRKLREDGHYVCISTGRPFRASSMYYDQLQLDTPIVNFNGAFVHHPKDESWGRFHTSLDLEVVKQIIEVSETYNVHNILAEIVDDVYFHYHDEKLIDVFTMGSPNITVGDLRTNLGQDVTSVLIHAKEEDVPAIRSYLSDVHAEMVDHRRWAAPWHVIELIKSGINKAVGLEKITDYYGIPPERVIAFGDEDNDLEMLEFAGCGVAMGNGIEGVKSVANKVTKSNEEDGIAVFLKDYFAL

SEQ ID NO: 5325 - protein, 255 aa, Bacillus licheniformis
MIIIEKQHISNIPLLHIVKEEKKEKALPLVFFIHGFTSAKEHNLHFAYLLAEKGMRVILPEALYHGERNEQLTQEELAPRFWEIVTNEIKELEVLKNHFERENMIEKGRIGAAGTSMGGIVTLGALTQYEWITTAVSLMGSPAYVEFFDQQLAFMREKKIELPITEEQIDQQREELKRFDLSLQPDKLNMRPLLFWHGKQDGTVPFALTRRFYESIIPLYEARPDLLHFIEDERAGHKVSREGLLKTVEWFDAHL

SEQ ID NO: 5326 - protein, 102 aa, Bacillus licheniformis
MDEALKENIMGALEQVVDPELGVDIVNLGLVYDVNMDENGKTDVTMTLTSMGCPLAPIIVDEVKKALADIPEVKEVDVHIVWNPPWTRDKMSRYAKIALGIQ

SEQ ID NO: 5327 - protein, 345 aa, Bacillus licheniformis
MKIGIIGATGYGGAEIMRIMRTHPYADECILYSSSDEGARYDAAYPHLVKLTDQHLQPIEVKRIANEIDFLFMAAPPGISSRLTPQFDAYDIPIIDLSGDLRIQNPSVYEKWYKREAAPEHVLQKAVYGLSELNREDIKTAQYIANPGCFPTAVLLGLAPLVKSGSINESFVIIDAKTGVSGAGRKPSMGTHFSEVNDNFKIYKVNEHQHTPEIEQTVKQWNSAFKPITFSTHLVPMTRGIMATIYTELKDSMDAEQLQLIFSKFYKDSYFVRVRETGSFPATKEVYGSNFCDIGVTVDERTNRVTIVSVIDNLMKGAAGQAVQNFNIMNGLSETAGLEFTPIYP

SEQ ID NO: 5328 - protein, 406 aa, Bacillus licheniformis
MIQVSQDSIKKTDGSVASPKGYLAKGVHCGLRYSKKDLGIIISSRPAVSAAVYTQSHFQAAPIKVTQESLKKSAHLQAVIVNSANANACTGEQGLKDAYEMRRQSADMLGIEPDLVAVSSTGVIGEYLNMENITKGISLLAETEPAEGDFEEAILTTDTVIKQTCYELMIGGQKVTIGGAAKGSGMIHPNMATMLGFVTTDACIEESALQRALREITDVSFNQITVDGDTSTNDMVLVMANGCAGNERLHEEHEDWPVFKKGLQLVCTDLAKQIARDGEGATKLIEVEVNGAKSNLEAQIIAKKIVGSNLVKTAVYGTDANWGRIVVAIGDSMAAVTPEKVEIRLGGQCLFKNNEPQPFSEELAKTYLENSEVKIEVFMQEGEGKGTAWGCDLTYEYVKINASYRT

SEQ ID NO: 5329 - protein, 258 aa, Bacillus licheniformis
MGKTIVFKCGGSVIRELSDEFFQNLKDLTESGWKIALVHGGGPDITKMLKKLNIRTEFVNGQRKTTKAVLEVAEMVLSGSINKFFVAELTKHGLPAVGVSGKDGGLLLADYLNEKEYGQVGRIKKVNGQMAEALMEKGFIPVIAPLSMTDGCETLNVNADLAASAVAAALRADKLMFVTDVKGIMKNEEMLKELTPEDIESLIAEGVISGGMIPKVHSAKEALTDEVEEVMIVSGKGSFLTKDDFIGTKIIKQKEAVS

SEQ ID NO: 5330 - protein, 385 aa, Bacillus licheniformis
MSHLFQTYSRWNINIKKAKGTIVQDEKGNAYLDFVQGIAVCNLGHCPDSVTAALKKQLDDVWHVSNLFQNELQEKVAQLLAKNSAGDLVFFCNSGAEANEGAVKLARKHTKKTKIVTFQQSFHGRTYAGMAATGQEKIKHGFGPMLEGFHYLPYNEPKAFAELQDEKDIAAVMLEPIQGEGGVIPASREFLQSVQDFCRDKQALLIIDEVQTGIGRTGKAFGYEHEGLSPDIVTVAKGLGSGFPVGAVIGKKELSEAFSPGSHGTTFGGNMLAMAAANATLETIFDRSFLEEVSAKGAFLHQQLKDKLQFPLVKDIRGKGLIAGIECKEPVQPLIEALQKEGLLVLPAGPNVIRLLPPLTVAKSEIKAAVEKLKDVMANHSAVKQ

SEQ ID NO: 5331 - protein, 354 aa, Bacillus licheniformis
MEGYLVLEDGTSFSGELDGLDGCTGEVVFFTGMTGYQEVLTDPSYKGQIIVFTYPLIGNYGINGSDAESKQPQVRGVVVYEACDRFSHHQATESLREYLAKWDVPLLSHVDTRAVVQHIRAKGTLNARLTKQKDDIPAPRQLENYAAQVSGQNENGAFGEGNTHIALIDFGYKKSIASSLANRGCKVTVVPYQEMDGIAKLNPDGIVLSNGPGDPKAILPYMDALRGIISSYPTLGICLGHQLIALAFGSDTYKLPFGHRGANHPVMDKETGRVFMTSQNHSYVVDRDTISENEFSVRFHHVNDGSVEGLMHKTLPVLSVQFHPEAHPGPAESEWIFGEYLQKLNEARREIAHA

SEQ ID NO: 5332 - protein, 1029 aa, Bacillus licheniformis
MPKDQTIKSILVIGSGPIIIGQAAEFDYSGTQGCMALKSEGYRVILVNSNPATIMTDESFADEIYFEPLTVESLTQIIKREKPDGLLANLGGQTALNLAVELEKAGILKAYGVKLLGTSVDTIEKGEDREKFRALMKELNEPVPDSEIVDNQDDALRFALSIGFPIIVRPAYTLGGKGGGIAATKEEFLPLIESALLASPIHQCLVEKSIAGFKEIEYEVMRDSNNTCITVCNMENIDPVGVHTGDSIVVAPSQTLTDADYQMLRSASLKIISALDVVGGCNIQFALDPESKNYYVIEVNPRVSRSSALASKATGYPIAKMAAKLAVGYTLAELKNPLTDSTYASFEPALDYVVVKFPRWPFDKFKQADRKLGTKMKATGEVMAIDRNLEAALQKAVASLELKTSGTHLPELGGVSSEVLWKLLETPDDRRFFAVMELLSRGTSISEIHEKTKIDDYFLHVFSNIIQLENTLMEQGDSLSVSLLKKVKEKGFTDFTIASLTGKTEEEVRALRKKMGIAASFKIVDTCAAEFDAKTNYFYSTYFGKSDGDISQKTKKRALIIGSGPIRIGQGVEFDYSAVHGVMTLKSLGFETIMLNNNPETVSTDYEMADRLYFEPITPEHILNVAEAEDIDFAIVQFGGQSAINVAQAIEKAGITLLGTSSETLDILEDRDQFYQLLDELGISHAKGETASSKAEAVKKANEIGYPVLIRPSYVIGGMGMMIVHSEAELRELLGGASQMPYPILIDQYVSGKEFEIDLVSDGGDLYIPTYIEHIEKAGVHSGDSYAILPGPSVTPEMKSAARDAAAKIVRKLGFKGIMNIQFIADSDELLILEVNPRASRTVPVVSKVMGVPMIPLAAKLLAGSSLKELKPAAKNSRGVAVKFPVFSSHAIQDVDLKLGPEMKSTGEGMYVGFNPESALKKIFAGIWQTKGCIYMEGAGELRSLAEQAGFTVQSDDFPGWIKRKDKALHIHLAESKEARKQRIEAVTHGVAVMTEEETVRAFLTSGHGTTKAVSLKDLYKKEVETCLL

SEQ ID NO: 5333 - protein, 316 aa, Bacillus licheniformis
MSTVNIGATREINLSGKDFLSLKDFSKEEIVYLLKEAAAMKRNKIQDIFKGKTLAMIFEKSSTRTRVSFEAGMAQLGGNALFLSSKDMQLGRGETIADTAKVLSRYVDAIMIRTFEHEKVEELAKHAEIPVINGLTDLFHPCQALSDLLTIQEMKGTLKGLKAVYVGDGNNVAHSLLIGCAKVGCDITVASPKGYEPNQDVVKLAETFAEESGAAVTITNDPVSAVQQADVIYSDVFTSMGQEEEAEERMKIFAPYQVNGTLVSHAKPDYIFLHCLPAHREEEVTAEIIDGPNSAVFQQAENRLHVQKALLKALLS

SEQ ID NO: 5334 - protein, 270 aa, Bacillus licheniformis
MDFLVLIKYILLGLLQGFTEPIPVSSSGHLVLAQHFLGLNIEGFSFELLMNAGSLIAVLLVYKNDIFRLAVNGLSYVTTKNEKGKADFRFIIYLIIATIPAGVIGVLFDDEISAFFKDGVRITAVTLLITGLALFLIRNLRGRKSDGEIRLRDAVIIGFSQMVALVPGISRSGATIVPAMALGLKSETALRFSFLLYIPVSLGGTILSITDIFHDPRLGELFLPYLFAFIASVIATYFSLRWFMNIMAKGNLVYFSIYCFVIGIAVLIFA

SEQ ID NO: 5335 - protein, 59 aa, Bacillus licheniformis
MGQQRQFRPGQKAPNNGVYVEIGETGSMVQNPQQIKLSAGEFFPETSNHNRLWTYKRKP

SEQ ID NO: 5336 - protein, 61 aa, Bacillus licheniformis
MRFVVAFFWTFLLTQMACYIVGAMNGAGYDLQTSVIMGFIITAAVIVLGEIMPVKQDASQH

SEQ ID NO: 5337 - protein, 244 aa, Bacillus licheniformis
MKITERFFQMDSEWNVVHLPYKPNGFLVFIFGDRNHFVGEDSSFWLQHYGRNQLLTSLRNKGYTLVNSNLFGRHWGSEKAVAYAKQLIHYVFKQEILNEKIHLLAEGTGALIADELLRSIPNQIRSTAMVNPCLDLQAHHKREKENKFFYKQFIKEIAESYGITEREAADYPFKSISPYHNLVPVHIWQRLNGSPYPYMIHAKTFEERQLKGRHSVGLTLHLSEHPQRIHSAIANFFKTHEKVL

SEQ ID NO: 5338 - protein, 191 aa, Bacillus licheniformis
MKPALVYGADEFFGLSFCEHLLEEGVDIDVKLEQTSDEKKLMYLEERLMWLGRNEHFRLIEKELEAPYEQVFIQYTGSVPEEALAAGVENKPVILFVYQEQLEEDLRAGMEEKGVELIVLPDLFGPWDVRAEDKQNRDGALFVNDAAAQAAACAVEKDFSDLQFVQKTPYDKADEIIEEWIRQMSTFFDKK

SEQ ID NO: 5339 - protein, 317 aa, Bacillus licheniformis
MVYRLVAIFFILLALSGCGQSPLKGKIEKVGLLVPDTINDQVWGTKGYKGLLRIQSVYNVDVYYKEGIDNDAAIKMAVEDFHKKGVNLIYGHGSEYEKAFNEICKDYPDIHFVLMNSKADHQNVTSISLEGEAMGFFGGMTAAHQSKTKKIGVLATYKWQPEVEGFSEGAKYLDPDIEVMTEYVGQWDDSENAVKLYEKMKKAGADVVYPAGDGYNVPVIEQIKKDGLYAIGYVSDQSELGENVVLTSTIQHVDDAYELTADEFNKGTLKGGKRSFDIQDGVIEMGEFSPVVDQSFQEKMNRLIDEYKKTNKLPNEH

SEQ ID NO: 5340 - protein, 79 aa, Bacillus licheniformis
MTNTKKQTNCQTNIEVIKMHEKSMEFLQIAMKYVPEAKAEMEKAGIELSPEMLEPFMNLFTKVMAEAYELGKAEAGSDA

SEQ ID NO: 5341 - protein, 80 aa, Bacillus licheniformis
MANDDFFTKMMFGSNAPARHEETETDAEAETAEDAEVSQEADYMHVLNQVGEIMDSLDELKPVFKEIGSMVSALKNKISI

SEQ ID NO: 5342 - protein, 312 aa, Bacillus licheniformis
MKAGIIGIGRYIPEKVLTNFDLEKMVETSDEWIRTRTGIEERRIAAEDEKTSDMAVAAARRAMEDANIEPEDLDMILVATVTPDQAFPTVSCMIQEKLGAFNACAMDISAACAGFMYGLVTGKQFIEAGTYKHVLVIGVEKLSGITDWDDRNTAVLFGDGAGAAVVGPVSDDKGILSFELGADGRGGKHLYLDEKDHTIMNGREVFKFAVRQMGESSVNVIEKAGLSKEDVDFLVPHQANIRIMEAARERLELPVEKMSKTVHKYGNTSAASIPISLVEELEAGKIKDGDVIVMVGFGGGLTWGAIAMRWGR

SEQ ID NO: 5343 - protein, 412 aa, Bacillus licheniformis
MNSKRVVITGLGALSPLGNDVKTSWNNAINGVSGVGPITRVNADEYPAKVAAELKDFKIEDYMDKKEARKMDRFTQYAVVSAKMAVEDAGLDINESNADRIGVWVGSGIGGLETLEQQFETFLTKGPRRVSPFFVPMMIPDMATGQISISLGAKGVNSCTVTACATGTNSIGDAFKVIQRGDADVMISGGTEAPLTRMSFAGFSANKALSTNPDPKTASRPFDKNRDGFVMGEGAGIVVLEELEHALNRGATIYAEVVGYGSTGDAYHITAPAPNGEGGVRAMKEAIKDAGLSPVDIDYINAHGTSTPYNDKFETIAIKEVFGEHAYKLAVSSTKSMTGHLLGAAGGIEAIFSVLAIKEGIIPPTINIETPDEDCDLDYVPDQARRQDVNVVLSNSLGFGGHNATLIFKKYE

SEQ ID NO: 5344 - protein, 262 aa, Bacillus licheniformis
MSIASTYEWLEQASSVRELPSFLLPYFKGASKADAAAIVSHLQIHGLFRSWTDGERTMKQLKENGVFQHVRREEQLLCKRWNGPDVPIFILPVDERNRKIRVEFGSKSGLAFSDKLFLFLSADLPRSSISAIMTHEYNHVCRLENMPKEEKKMTLLDTIILEGLAEYAVFERLGEAETAAWTSYYSEKQLRHFQDRFVKPHFDLRRHDGRLFSNILFGKGHYPDMLGYAVGYSIVKKYLSARKLKVADVLAFPSEDFIKLSL

SEQ ID NO: 5345 - protein, 324 aa, Bacillus licheniformis
MSALLEVNDLKTYFFRKKQPIPAVDGVDFSIKKGETVALVGESGSGKSITSLSIMGLVEGSGGKIMSGSIKLEGQDLVTYKEQDLCKIRGNEISMIFQEPMTSLNPVLTIGEQITEVLIYHKKLSKKEAAKKAVELLKLVGFSRAGELMKEYPHRLSGGMRQRVMIAIALSCNPKLLIADEPTTALDVTIQAQVLELMKDLCDKFDTSILLITHDLGVVSEIADRVIVMYCGQVVENATVDELFDEPLHPYTKGLLNSIPVIEGSIEKLTAIKGNVPTPDNLPAGCRFAPRCPSAVDKCWGAQPDLKTRPDGRSVRCFLYEEGE

SEQ ID NO: 5346 - protein, 340 aa, Bacillus licheniformis
MTSSAEQLQPGQEMNPQESLLELKDVKKYFPIRSGIFQKKIGDVKAVDGISFSLKRGETLGIVGESGCGKSTAGRTMIRLYKPTAGQIFYKGRDISSLSEEALRKSVRKNIQMVFQDPFASLNPRKTLRSIIKEPFNTHHMYNFKERNEKAEELLAKVGLHPSFANRYPHEFSGGQRQRIGIARALALNPELIIADEPVSALDVSIQAQVINLMEELQEEFNLTYLFISHDLSVVRHISDRVGVMYLGKMMELTDKHELYGNPLHPYTQALLSAVPVTRKKGGTKRERIVLKGELPSPANPPKGCVFHTRCPAAKAICAEAEPAFKEVKTNHFVACHLYE

SEQ ID NO: 5347 - protein, 547 aa, Bacillus licheniformis
MNKRKTGFSILSLLLILSIFLTACNSGEVGGDEKEGKSDGKPQQGGDLIAGSTGEPTLFNSLYSTDTASSDIERLIYNTLLDVNEKLEVENQLADEVKESEDGLTFDVKLKEGVKFHDGEEMTADDVVFTYSIPMSDEYVGERGSNFKMIESVTKKGKYEVQFKLKKQDPYFYNVTLASYGILPKHILKDVPISKLGEHEFNRKNPIGTGPFKFKEWKEGQYVKVEAFDDYYAGRPHLDSITYKIIPDSNAALSQLQAGDVDYLVVTPGPDYKTAEKFNNVKMETDLGLNYTYIGWNERNELFKDKKVRQALTHALDRQALVDQVLDGDGEIANIPESPLSWNYPDNKDKFKTFEYDPEKAKKLLKEAGWTDSDGDGILDKDGKKFSFVIKTNQGNKTREDLAVVVQQQLKEIGIQAKPQIVEWSALIEQMNPPNWDFDAMIMGWSLATFPDQSNIFHSKEAEKGLNYVWYQNEKLDKLLDEAKTLKDREEYKKAYEDIYEILAEDQPYTFLYYTNYHRAMPKNMKGYVFHPKEDFYKAEDWWLDQK

SEQ ID NO: 5348 - protein, 316 aa, Bacillus licheniformis
MITYIIRRTLMSIPILFGITILSFAIMKAAPGDPMALMMDPTISAGDREKFIEKYGLDEPEHVQYLKWLGNMVQGDFGTSIVRKGTPVTDLIMARLPNTLLLMLVSTILALLISIPLGVLSARRPYSKLDYGITFTSFIGLAVPNFWLGLILIMFLAVNLGWFPTGGVMTLNADFSLWDRIHHLILPAFVLATADMAGLTRYTRSSMLDVLRQDYMRTARAKGFKENRVVYKHGLRNGLLPVITIFGLMIPSFIGGAVVTEQIFSWPGLGKLFVDSAFQRDYPVIMAMTVISATLVVIGNLVADILYAMVDPRIEY

SEQ ID NO: 5349 - protein, 304 aa, Bacillus licheniformis
MTQTNPSTPSPEITLQENVAPKPETMTKIFFEKFYKNKLAVIGGVLLFIIILSAIFAPVIAPYPPEQQNLLNKLKPPSGEHLMGTDKFGRDIFSRLLYGARVSLLVGFASVLGSITIGTVVGAIAGYFGGIIDAIMMRLVDIVLSIPDIFLLITLVTIFQPGIDKLILIFALTRWTTTARLVRSEFLSLRSREFVLAAKTIGTRNYKIIFSHILPNAMGPIIVAATLSVGTVILAESALSYLGFGVQPPMASWGNMLQDAQNFTIMIQAWWYPLFPGLMILLTVLCFNFLGDGLRDALDPKNIK

SEQ ID NO: 5350 - protein, 421 aa, Bacillus licheniformis
MLSVLKNKNFLFLILGRLVTNIGDSMYTVAAMWLVFDLSKSTFYSGLAGFLTMFPTVLQFLTGPIVDKVRLNKVLVWSQLIQAILVLIIPLFYFIGYLNIWIIMMIMPLIVFIEQFTYPAQSAALPKIIKSQDLVKANSLMSFSYQGTDIIFTGIAGIVIASAGAISIYLVDSFTFLLAALFFKCVKLEQKNEIEHKPRFHFKKVIHNYTTDIKEGFTLIRHSLIPKILLGSMISNFMLSATIVILPSFSSIRGGEEYYGYYLASMSCGLLLGSIFATVFGRFAIGSLTIYGFFISGVLWSISAIATSSYISIILFGLSQISIGVTNVIFMSILQSILPEEFIGRVFSFIASLTSIAAPFGSLLGGFTASLIGSDKVFFIGGIAMLFVSVYWVFQSSLRSIPSSEKINAKEYSFFTNVLNK

SEQ ID NO: 5351 - protein, 249 aa, Bacillus licheniformis
MFLHDVWVNWFEGEENGYNVCHFHEWRKEDSVELLDQVPLLRVSSVLFHYIENDLSELPAELLNEVHQKAYIRKNHERTQLDHCFVVTDGIGILAVDTAGYTIPVRKSRLIPRQEQLVYEMVKDVEAETYEFAPEKLQSSKEYHILSLSPEHVRGLTRKERQLKQLLFMALDQLKGLQNRAEIAYWYTEWNPYMYEQIKRMTFEEIWDMLFNETIDGWSDKHRDFCENLIKGQPFFEKLWEIENESKVN

SEQ ID NO: 5352 - protein, 330 aa, Bacillus licheniformis
MKKTIFSGIQPSGSVTLGNYIGAMKQFVDLQDDYNCYFCIVDQHAITVPQDRLALRKNIRNLAALYLAIGLDPKKATLFIQSEVPAHAQAGWMLQCVAYIGELERMTQYKDKSAGKEAVVSGLLTYPPLMAADILLYGTDVVPVGEDQKQHLELTRNLAERFNKKYNDIFTVPEVKIPKVGARIMSLADPLKKMSKSDPNQKAFITLLDEPKQLEKKIKSAVTDSDGIVKYDKENKPGVSNLLTIYSILGQASIEELEAKYEGKGYGEFKSDLAEVVIGALKPIQDRYHELIESEELDRILDEGAERANQTANKMLKKMENAMGLGRKRR

SEQ ID NO: 5353 - protein, 541 aa, Bacillus licheniformis
MKKRLSFISLMLIFTLVLSACGFGSSSGDGGKKDSKGKDTLNVNIKTEPFSLHPGLANDSVSANVLRQTFEGLTTIGKDGKPVEAAAEKIEVSDDQKTYTFTLRDAKWSNGDPVTAEDFEYAWKWALDPKNESQYAYQLYYLKGGEAANTGKGKIEDVGVKAVNDKTLKVELEKPTPYFTELTAFYTYMPVNKKVAEKNAKWYTNADENYVSNGPFKMAKWKHSGNIVLEKNDQYWDKDAVKLKKINMAMVNDPNTGLNMYKKGELDFVGQPLDQISTDAIPSLKKEGLNIDPFASVYLYKFNTEAAPLNNVNIRKALTYAINREAIVKNITQAEQLPAMGLVPPAVHGFESNKGYFKDHDVDKAKEHLEKGLKELGLKKASDLPKITLSYNTDEAHQKIAQAVQEMWNKELGVDVELGNEEWNVYIDKLHAGNYQIGRLGWTADFNDGMNFLETYRDKEGGNNDTNWENAKYKELLNKASRETDSAKRIELMKEAESIIMDELPVAPIYFYTMPYLHDESLKDFVLTGTGEIYFKTAHFE

SEQ ID NO: 5354 - protein, 311 aa, Bacillus licheniformis
MIKYLGRRLVYMLISLWVIVTATFFLMRAIPGGPFSGERKLPPAIEASLNSYYGLDQPLFKQYLDYLVSVAKWDFGPSFKYKGQTVNDLISSGFPISFTLGLEAICLALAFGVLFGVIAALKRNKWQDYTAMIIAVVGISVPNFIMAALLQYVLAMKLGMFPVAQWESWGHTVLPAIAVASMPMAFIARLTRSSMLEVLSSDYIRTARAKGLSTSAVTFKHAIRNAIMPVVTYMGPMAASILTGTFVVEKVFGIPGLGMHFVTSITNRDYTVIMGVTVFFGAILLLCVLIVDLLYGLIDPRIKLFGAKKGE

SEQ ID NO: 5355 - protein, 305 aa, Bacillus licheniformis
MQQIPKDMFEPAAVDHSEAEKISKKNLSFWTDVFLRFKENKLALFGLVVLILIALMAIFAPVFSSFQYEETDLTNANQPPSGEHWFGTDDLGRDVFVRTWVGARISLTIGLAAALIDVLIGVIWGAISGIRGGRTDEIMMRIADILWAIPSLLMTILLLVVMGKGLITMIVAMVITGWINMARIVRGQVLQLKNQEFVLASRTLGAKNSRIIRKHLLPNIMSPILVTMTLTVPTAIFYEAFLSYLGLGVPQPLASWGTMATDGVQGLEYYPWRLFFPATFICLTMFAFNVIGDGLRDALDPKLRK

SEQ ID NO: 5356 - protein, 355 aa, Bacillus licheniformis
MKHLLEVKDLAISFKTYAGEVQAIRGVNFHVDKGETLAIVGESGSGKSVTSQAIMKLIPMPPGYFKNGQILFDGQDLVPKTEKEMQSIRGKEIGMIFQDPMTSLNPTMKVGRQITEVLFKHEKISKEEANKRAVELLSLVGIPMPERRVNQYPHEFSGGMRQRVVIAMALAANPKLLIADEPTTALDVTIQAQILELMKDLQKKIETSIIFITHDLGVVANVADRVAVMYAGQIVEIGTVDEIFYNPKHPYTWGLLASMPSLDNDGDEELMAIPGSPPDLTNPPKGDAFALRSPYAMKIDFEQEPPMFKISDTHYVKSWLLHPDAPKVEPPAAVKSKMKEFKNQYEKPVQVKEGE

SEQ ID NO: 5357 - protein, 307 aa, Bacillus licheniformis
MAEKLLEIKNLKQHFSTPKGIVKAVDGISFDIYKGETLGLVGESGCGKSTTGRSIIRLYQATSGEVLFKGKNVHDKKSAKDLLEFNRKMQMIFQDPYASLNPRMTVADIIAEGIDIHGLAKTKKERLERVHELLNLVGLNKEHANRYPHEFSGGQRQRIGIARALAVEPEFIIADEPISALDVSIQAQVVNLMKDLQKERGLTYLFIAHDLSMVKYISDRIGVMYFGKLVELAPADELYENPLHPYTQSLLSAIPLPDPDYERTRVRKTYDPSVHQLKGDEQMELREVKPGHFVMCTEEEFKAYQSK

SEQ ID NO: 5358 - protein, 192 aa, Bacillus licheniformis
MNWYEKLSEYFPIEEMKSKEHMEALLKEQNDIYHKEEGRHHVLMYAEFDSFIFIDYLFVSKDARGQGLGSKLIEKLKKKNKPILLEVEPVDEDDADTAKRLKFYQKENFKHAESIGYRRRSLATGKVNKMEILYWSPKSNTEKEVFDAMKETYEKIHTYKDEKWYGESYEDVDDVLTIVDDHKQKNIFDELS

SEQ ID NO: 5359 - protein, 131 aa, Bacillus licheniformis
MVTLYTSPSCTSCRKARAWLEEHDIPFTERNIFSEPLSIDEIKEILRMTEDGTDEIISTRSKVFQKLNVNLETMPLQELYQLINEHPGLLRRPIIIDEKRLQVGYNEDEIRRFLPRKVRTFQLREAQRLAN

SEQ ID NO: 5360 - protein, 220 aa, Bacillus licheniformis
MEHDILMSFLVIIGIDLILGGDNAVVIAMASRHLPPRQRQKAIIIGTLIAIMMRIALTMAAVYLLAVPYLQFIGGIFLLYLGYQLLIEKKDAQHVKGGTSLFKAIRIIVIADLFMSLDNVIAVAGASHGRLMLVVVGLMVSVPVIIWGSRLIQAALAKFPLLIYAGSGLLAYTGGEMIVREQELSSFMAQHSTLEMLLPVLTVIFVILASIYYEQTSEKH

SEQ ID NO: 5361 - protein, 212 aa, Bacillus licheniformis
MEIERINEHTVKFYISYGDIEDRGFDREEIWYNRERSEELFWEMMDEVHEEEEFAVEGPLWIQVQALDKGLEIIVTRAQLSKDGQKLELPIPEDKKQHVAEESLDALLDDFQKEEQAEEQKLQFVLKFDDFEDLISLSKMSVSGCQTTLYSHENRYYLFVDFNELPDEEVENQLSILLEYASESKMTIHMLKEYGKLIAADHALHTIKKHFA

SEQ ID NO: 5362 - protein, 338 aa, Bacillus licheniformis
MTKRGRCYGFTILLVFALILGGCGGNTASNKAANEKDFKPSKAIEVVAPAGAGGGWDTTARTISKIMGEEKLIEKMAVVNKPGGGGASGWSYVHRKKGDNHTLFVTSPPILFVPLNGQSQYGHNDFTPIASVIADYGAFVVHKDSPYQSMTDLVDALKKDPKAASIVGTSSPGSMDHMQFVSAVQKAGVDAKKLKYITAQDGAGMSMLLGKKADVYSTGVGEAAEQARAGKVRVLAITAPERMKGDTVKDFPTLKEQGIDDEFTVWRGFMGPPGMSKSAVKYYEEKIKEMMEKDSWKSIRDSYGWTDNFMGHQEFKDYLDTQYKEMKALLDEIGLGDK

SEQ ID NO: 5363 - protein, 151 aa, Bacillus licheniformis
MRITNRAVSVIILAVAAIYLALSFNLDSYPYAVIDADVLPKSLGILLLILGIFLFFEKDQKDTTVKKLFQLQKKDVKVMMLCVVSLLIYISVLEFIGFLLSTVMLLLVLPAVLGYRNWKTAAIVSLVFSSTIYFSFNYVLNIMLPQGVMPF

SEQ ID NO: 5364 - protein, 501 aa, Bacillus licheniformis
MLDSILYGFQVALTLQNIMFAFIGVLIGTIIGMLPGLGPITAIAIMIPLSYGMDPASALILMAGVYYGAVFGGSTSSILLNAPGVAGTVATSFDGYPMAKQGKAGKALAIAAICSFAGGTITVVALMLVAPTMANIAVTFGPTEYFALMMLGLVAISSLSEGSTVKALISATLGFMTATIGIDPQTGTERFTFGAASLLEGIDFLIVALGLFALAEVAFLIKTRNKPMTEGASQVGSLKVTKSEMKEISGPIARHSVIGFLLGILPGAGATIASFISYITEKRISKHPETFGKGNIKGVAAPETSNNAATSGAFVPLLTLGIPGSGTTAVLLGALLVVGVQPGPLMLTDHPDVFWGVIASMYIGNLFLLILNLPLIPFLSKILLIPKQLLISLIFVFCLIGVYAVTFNVVHLYILVFFGILGYFMRVLSFPAAPFILAFILGSLMEESFRQAMTLSSGSLSVFFESPVTIGLLITALLSLIVPPISRAMKNRNKKSIDLEG

SEQ ID NO: 5365 - protein, 238 aa, Bacillus licheniformis
MKALQVFIVEDDIRNADIHQKLISKIDGFSVIGIAENFQDAKDLLPDVKPDLVLLDIFLPDGSGMELLWLIRQTLRHTDVMMITAAKEVEYVEQAIRAGAVDYLIKPIMFSRLKETLLNYRSYRLKVNEMSSIDQTDVDSLMAKRRSITKEQIAKADYPKGIDGLTLKKVAGVLNKSENSDGITAESLGRTIGVSRTTARRYLEFLAAEKHVKTELYYGTVGRPERRYKPVKNESPET

SEQ ID NO: 5366 - protein, 531 aa, Bacillus licheniformis
MRKGVFDIKRKLTTKLTLLILTLLLLLLSVMSGLYLIILENSLKTQIQARALDMAKTLAHMPSVQKAFETDDPSRTLQPIAENARKQSGAQYIVIGSADAIRYAHPDPGKIGKPMVGGDNRRALEKGEAYVSEAVGTLGPAIRGKAPIHNENGEIVGIISVGFLIENIQDIVYQYQSKFIFLLGFVVLMGILGAVYISRNVKKSIFGLEPYEINQLYTEKQAITESVHEALIAINKHEEITLLNRKACELLRVESEDQWLGKPISELLPDTLLPEVLKTKTAQKDQELTIGNEELIVNRVPIFENEKIRGAVASFRRKTDIDELSKKLAQTSQYAEGLRAQTHEYSNKLNTIAGLIQLESYPEALELIQKENKSHQDMLQFLIHSIPDPLLSGLLLGKVNRAKELHINLEIDESSKLNALPDEMDKGKFITILGNLIENAFDAVSHKKDRSILVFLSDGADHILIEVEDSGDGIPKGEQERIFQKFYSTKTANHRGLGLFLVKEAVNALNGQIKADKSDLGGALFTVVIPK

SEQ ID NO: 5367 - protein, 382 aa, Bacillus licheniformis
MFSAMIDQGGTICLADGYKAEDLKRLRKRHAFYCPVCRCELDLKIGSVKLPHFAHKPDAACPVPHEPESPYHLKGKRLLYEWLGRQGLRPVLEPYLQEIRQRPDLLLEHGTRQVAVEFQCANLNAAAYRKRTEGFLRLGIEPVWILGGNRIKRLTGDLFQLSRFHWQFIQKSDKPPKLLFFCPEQKAFIILEHLIPFQTNKTSASLRFLPLAEASWRNVTERESRSPLQLKGWKKNILSFRMSAVRFLSKETKQIAALFYENHQLPLPFFPSEAFLPVPSGYIFAHPVYVWQGYLFLFITKHDTFRLQSALHYMDWLIKGKRLKLRWSGRQTAADAVGEYICFLHKKGFLVRKEEFYYSAGSFVPEPRLEALLKRDEHYFSE

SEQ ID NO: 5368 - protein, 667 aa, Bacillus licheniformis
MSGLFQIKRYVFYFLTAGFCVFFFAYDLTKDGEKTEDEHNTSLLDNNGLGVKKARGLTVAEEKKSKKLPSREEVKQEDTWRLEDIFPSDDAWNEEFQAVKELLPKLSEFKGKLGHSADDLYEALTYQDKVMERLGKLYTYAHMRYDQDTGNSFYQGLNDKAANLYTQAASATAYMVPEILSIQEEKLQQFLLEKEELKLYSHALEEINKERPHVLSEEEEGILAEASDVLSSPSNTFGMLNNADMEFPEITDENGEKVQLTHGNYITFLESENRDVRRAAFKAVYETYGRFKNTLASTLSGAVKKDNFYAKVKHYKSAREAALSRNSIPEEVYDNLVSTINKHLPLLHRYVEIRKKVLELDEVHMYDLYTPLVKDSGMKVTYEQAKDYMLKGLAPLGEEYSSILKEGLNNRWVDVYENKGKRSGAYSSGTYGTNPYILMNWQDNVNNLFTLVHEFGHSVHSYYTRKYQPYPYGNYSIFVAEVASTTNEALLGEYLLNTIEDEKQRLYILNHMLEGFKGTVFRQTMFAEFEHEIHVKAQEGEPLTPELLTSIYYDLNKKYFGDNIEIDKEIGLEWSRIPHFYYNYYVYQYATGFSAAQALSQQILKEGKSAVDRYIEFLKAGSSDYPIEVLKKAGVDMTSSEPIEAACKKFEEQLNEMEELLQKVNHS

SEQ ID NO: 5369 - protein, 50 aa, Bacillus licheniformis
MGLASILFFFVLNILGLMNMLPLYITSPLLFISILFTISRLNHRKTFKGF

SEQ ID NO: 5370 - protein, 300 aa, Bacillus licheniformis
MTLNQRDQFFSHCHGHPQKPMEIYMFVDPLSPECWALEPAIKKLKIRYGRFFTLRIIAACSITALNVQKRKKRRLAEAWEKIACRSGMSCDGTLLHDKALSAPYLASLALKAAELQGRKAGLQFLRCMQESLFLNQQDITEEQVLLAIAEHTQLDLEEFKRDLHSQSAVKALQCDLKIAAEMEVASVPTLTFFNSLREGEGLKVTGNYSYEIYEEVLFEMLGDEPKPSQTPPLELFIEYFQFVADKEIAVVYDWTLEQVEREMKKLAFARKVERVEAKHGMFWRYINEHHDAGPLYQCEK

SEQ ID NO: 5371 - protein, 132 aa, Bacillus licheniformis
MGQSFNAPYEAIGEELLSQLVDTFYERVKRHPLLYPIFPDDLTETARKQKQFLTQYLGGPPLYTEEHGHPILRARHLPFPITPERADAWLSCMKEAMDHVGLKGEIREFLFERLTLTARHMVNQPKMEDGSH

SEQ ID NO: 5372 - protein, 217 aa, Bacillus licheniformis
MNVNHLAALLELQAIRSFYPASDSGSEDAGFDFSSILNQYLSNVGGLESSQPAVAPTVSTASQLQAPLAAEKPEAIAAVPSAAAKPVSFGGQNQNIDQIIKNAAEKYGVDEKLIHAVVKQESRYQEKAVSPAGAMGLMQLMPSTAKALGVNNAFDPVQNIEGGTKYLKQMLDKYSGNVKLALAAYNAGPGNVQKYGGIPPFKETQNYVKKITSNYYA

SEQ ID NO: 5373 - protein, 190 aa, Bacillus licheniformis
MSQELEIEFKNMLTKKEFEKIKSYYQFSSEQFVIQKNHYYDTPSFSLKEKGAALRIREKQQRFVLTLKEPAPVGLMETHQELTRKPEIETFMIPHGPVYDRLKRLGIEADELILFGTLATSRAEKKLPQGLIVLDHSRYLMVEDFEIEFEVTDYERGKRDFSELLKSFGIPERETKNKIVRFYEQKLKDQ

SEQ ID NO: 5374 - protein, 121 aa, Bacillus licheniformis
MQNRIEITEANLRNDRLVLTSEINDGAERKPAGRMLTDSDHFAFVYILEQDESFEYVILNEGIWSDLKAALDAGLPVFLHIGNTELELNGFHDELGYLIENIKDNANYGEEMEERVKRIFL

SEQ ID NO: 5375 - protein, 211 aa, Bacillus licheniformis
MDEKQWEQFLAPYRQAVEELKVKLKGIRTLYEYEEEHSPIEFVTGRVKPVPSILEKAKRKNIPLHNIESMQDIAGLRIMCQFFEDIRIVVDMLLARKDFTVVDKRDYIAEHKESGYRSYHLVVLYPLQTINGEKQILVEIQIRTLAMNFWATIEHSLNYKYSGNIPEKVKLRLQRASEAASRLDMEMSEIRGEIQEAQAAFSRKKKDEDDG

SEQ ID NO: 5376 - protein, 267 aa, Bacillus licheniformis
MMKFAVSSKGNAVSDSLKSKIQTYLLDFGLECDEEEPDIVISVGGDGTLLYAFHKYSGRLDKTAFVGVHTGHLGFYADWVPSEIEKLVIAIAKTPYQIVEYPVLEVIVRYNDGSDEARYLALNECTIKSIEGTLVTDVEIKGELFETFRGDALCLSTPSGSTAYNKALGGAIIHPSIRAIQLAEMASINNRVFRTVGSPLILPEHHTCLIKPINDVTFQVAIDHLTLLHKDVKSIQCRVANENIRFARFRPFPFWKRVQDSFIGKGE

SEQ ID NO: 5377 - protein, 296 aa, Bacillus licheniformis
MSDFLMKQIITEEDSGVLLKEYVQRLGISKRMLTDIKFGGGDLLVNGGHVTVRYVLQKGDELVIQFPPEKMSESLQPEEVPLHILFEDDHVLVLNKQPCISSIPSREHPSGSLANGLIHYYQRTGVHATVHLVSRLDRDTSGVMLVAKHRFAHSLLSGLQKKGAVKRQYRAVVHGLIAEEQGTIDAPIGRKSSSIIERAVIPDGQKAVTHFWVNRRFSGMTDVSIRLETGRTHQIRVHMSHIGYPLCGDTLYGGTRGFINRQALHSERLTFFHPFTMEELTFQAPVPNDMRQLIES

SEQ ID NO: 5378 - protein, 246 aa, Bacillus licheniformis
MKYDVIGDIHGCYDEMIALIEKLGYSLTSGVPVHPENRTLVFLGDLTDRGPKSLEVVEFVGRAVEDGAVRYVPGNHCNKLYRFFKGNPVKLQHGLETTAAEYRNLPKQKQKDIRDLFMRLYEKAPLYEILHNGELVVAHAGIKAEDIGKKPVGKVKQFVLYGDITGETLPDGRPVRRDWAAHYRGEPWVVYGHTPVKNPRMIHHTINIDTGCVFGNRLTAFRFPELTTESVPSSLPYDESRFRMEP

SEQ ID NO: 5379 - protein, 614 aa, Bacillus licheniformis
MEHTSVSSLVVVLIIAFLTPILLHRFRLSIPVVVAEIIMGLIIGKSGFDLVAQHDTWLETLSMLGFIFLMFLSGLEIDFSVFEKGKKKQLLPSGKEAPNTFKTASVIFIAVFILSLGLSYSFVMAGFIDNAFLMTLIISTISLGVVVPTLKEERLMKTNIGQIILLVAVIADLVTMILLAVFASIYGDENSNMWLLMILFAAGVVLYIFGRVFKKRPFVEVLSKGTIQIGTRAIFTLIIVLVALSESLGAENILGAFLAGVLVSLLSPNKELVQQLDSFGYGFLIPIFFVMTGVKLDIWSLFGNPKILVMIPLLFVALLISKVVPVLFLKKWYDMKTVLASGFLLTSTLSLVIAATTIGERIGIIDAQMSGALILVAVITCIITPTGFKKLMPKTESEKEKKTITFIGANQMTLPVTLELSPEDYHVRILHVRQEKKEEKLADPVFDVEVLPDYEYETLQSFGVFQTDILVVATGSEERNTGIALYAKEQKVARIIASADSPDAESRLKENGIDTFSILLSTKTLLRALIEAPGVMKLLTNQDASLYQINMSNERFDGVLLREFPFTGDVIFVRIFRGVDSIVPHGDTRLQMGDRLIATGSREYIAELKKTLGD

SEQ ID NO: 5380 - protein, 233 aa, Bacillus licheniformis
MKFSEECRNSAATWWEGSFVHPFIQGIGDGTLPVDRFKYYVMQDSYYLTHFAKVQSFGAAYAHDLYTTSRMAEHAKGTYEAEMSLHRKFTDLLGITKEELESFQPSPTAYAYTSHLYRSVVSGSFAEILAALLPCYWLYYDVGETLKTCRPDNAIYQEWIATYGGDWFKKSVTEQINRFDELAENADEKTRAKMKENFVISSFYEYRFWDMAYQKESWSKSGVDQLASARDHR

SEQ ID NO: 5381 - protein, 203 aa, Bacillus licheniformis
MHLHAITDDKHSVEELSAKIISIHDAVDFIHIRERSKKVSEISSLIDRLAEEGVDKRKLIINDRVDIALFHHIHRVQLPSHGFSVKSVRSRFPHLKIGKSVHSPEEAVQAETEGADYVLFGHIFETDCKKGRKGRGALSLAEVKAAVRIPVIAIGGITEQRLAEVKMADGIAVMSGIFSHDRPNEAAARLASLAKGDSYEKAL

SEQ ID NO: 5382 - protein, 369 aa, Bacillus licheniformis
MRKRYDTIVIGGGIIGTSIAYHLAKAGKKTAVFESGEVGKKATSAAAGMLGAHAECDKPGTFFEFARASQKAYKRLTGELKDISGIDIRRHDGGILKLAFSESDREHLMQMGALDSVEWLEADEVYKLEPNAGKGILGANFIRDDVHVEPAAVCRAFARGARMLGADVFEYTPVLSIESEAGAVRVTSASGTAEAEHAVIASGVWSGALFKQIGLDKRFYPVKGECLSVWNDGISLTRTLYHDHCYIVPRHSGRLVVGATMKPGDWNEQPELGGIEELIRKAKSMLPGIESMKIDQCWAGLRPETGDGNPYIGRHPENDRILFAAGHFRNGILLAPATGEMMADMILGNPVKTEWIEAFKAERKEAVHR

SEQ ID NO: 5383 - protein, 67 aa, Bacillus licheniformis
MNIQLNGRKIEWRDDGGTIYDLLASYNLENRVVVVEKNRRIIGKDQYQTVKLEEHDVIEIVHFVGGG

SEQ ID NO: 5384 - protein, 255 aa, Bacillus licheniformis
MLKIADRQFSSRLLLGTGKYPSFEIQKEAVSASESEILTFAVRRMNIFEESQPNFLEQLDLSRYTLLPNTAGAKTAEEAVRIAKLAKASGLCDMIKVEVIGCDRSLLPDPVETLKASETLLEEGFIVLPYTSDDVVLARKLEELGVHAIMPGASPIGSGQGIINPLNLSFIIEQAKVPVIVDAGIGSPKDAAYAMELGADGVLLNTAVSGAKDPVQMAKAMKFAVEAGRLGYLAGRIPEKNYGIASSPEEGKLTI

SEQ ID NO: 5385 - protein, 336 aa, Bacillus licheniformis
MTGRYSRQELFHPIGPDGQEKLSRARVLVIGAGALGAASAEMLVRAGVGSLTIADRDYVEWSNLQRQQLYTEQDVIDHMPKAAAAEKRLRLINSSVQVTGIVADVTAEKALELAEEASLIVDATDNFETRLIMNDAAVKLGIPFLYGACVASYGITYSVIPGKTPCLHCLLGHLPANTMTCDTAGVIGPVVQQVAAYQVTDALKLLTGHEPSGMLRSFDIWTNERSEVRADTLKHETCPTCGKGEFPFLSAENETKAAVLCGRQTVQIRPAAEQPLELESLAAKLKKAGLNVTGNPYLVSCRAEDFKFVIFRDGRALIHGTNDINRAKTIYHRWIG

SEQ ID NO: 5386 - protein, 272 aa, Bacillus licheniformis
MSIYKALTIAGSDSGGGAGIQADIKTFQELGVFGMTVLTAVTAQNTTGVHGVYPLSPEALGAQIDAVAEDLKPDAVKTGMLWSAEMIEVTAEKIAAYELKRVIVDPVMIAKGGASLLNEEAVETLKRRLLPLAYAVTPNIPEAEVLTGRSIQTMEDRKKAARDLHEMGVRNIIIKGGHQPEDGKVTDLLFDGETFTEKTNSYIKTKNTHGTGCTFAAALTAQSAKGNGIQGAFRIAEAFVHEAVVHSLDFGAGHGPTNHFAYQKLSNAGLEL

SEQ ID NO: 5387 - protein, 258 aa, Bacillus licheniformis
MNLSLEGRNIVVMGVANKRSIAWGIARSLHNAGARLIFTYAGERLEKSVKELADSLERNDSIVLPCDVTNDQEIEACFADIKKEVGVIHGIAHCIAFANKEDLAGEYLNTTRDGFLLAHNISSYSLTAVAKAARGIMTEGGSIVTLTYLGGERVVSNYNVMGVAKASLDASVKYLASDLGKDGIRVNSISAGPIRTLSAKGISDFNSILKEIEERAPLRRTTTPEEVGDTAAFLFSDLSRGMTGENLHVDSGYHIIAR

SEQ ID NO: 5388 - protein, 159 aa, Bacillus licheniformis
MSSRKHDAEQKPLMYIVQPDYDKAEANMQDILIKRKKKAKPEASEQKARRKEQQDEAVRPDEKDGAEAVFNDEANRSEKGVKPIKKPLSKMTIAEKIDFLASLPGNMPKTLCLIEADGKTYRGTIVGKKGDSVFVRTSSKGAPAELPIESITSLHPLGF

SEQ ID NO: 5389 - protein, 149 aa, Bacillus licheniformis
MTKCSAENCVCEAVENIHDLQNAIEEEGCPTSCFSNLLSPSRHLGDTIPFILYTSKSKPFVAFGNVGELQAGPCFSTVFFRVENIDDCCATLRLLIAFDDNRRVLDFTEDKDKICDVFRLEKTSFCIEVDLECFCAIECLNPKLINRSN

SEQ ID NO: 5390 - protein, 162 aa, Bacillus licheniformis
MSCGKHHGRHENCVCDAVEQIIKEQDAVEETTACSTSCFGNLLSPTVSGKDTIPFLLYDKKGGLFSTFGNVGGFSDDMQCFESIFFRAESLKDCCATLSILRPVDINGDTLSVCHPCDPDFFGLEKTDFCIEVDLTCFCAIQCLSPDLVDRAADKKHNHHHG

SEQ ID NO: 5391 - protein, 176 aa, Bacillus licheniformis
MEGGKEMETRPYSWIALDPECEHPGNDYHPSYPKKKLCDDYTCNCGRKGQNGFIDSDLDQLHLNKQLSDETIIIKDSCDVQVSTEDTQTLASVMTAAQTLAVTIILAIIDDPDLAELVTTDLLQVTANKQTNRQKLVIDNSRNVHVTTEDTDTAIIVSTFVQTVVITITALIVGLL

SEQ ID NO: 5392 - protein, 132 aa, Bacillus licheniformis
MADFEKLQENVDPIMKSVVKNILKNRGVTSDKVRTLSEEEKENIFNMLEDLKKQTDALVQKQKEKAAAPNEKGTKREKNADASSENGERPRRRRNRTNRLREKLRQRREQENTATAENSTESDTSAEKNGDL

SEQ ID NO: 5393 - protein, 136 aa, Bacillus licheniformis
MDKKGVKVMSFHEKAEALYAETFDELHREYDQLIEVIDSEHVTVNTANITAALSLQAIVISLTILSAQLAIEDEDTADIVSEHLLAVHRLQSRRRVIIKVIGSRNVTITLSSLEILLSVQVLTEVLIALITELDIL

SEQ ID NO: 5394 - protein, 118 aa, Bacillus licheniformis
MIQSWFLFFLFSIAVFRLTRLIVFDTIMAPFRSLFHEEVEEKNEKTGETETYLVMKGKGVRAWVGELLSCYWCTGVWCTAFLLVFYAFVPVIAEWLILLLSIAGLAGVLETIVSKWLD

SEQ ID NO: 5395 - protein, 69 aa, Bacillus licheniformis
MNLFEQLVESIYRKHDQTQAGHDKVLFEQQKELETFDRSAEQFGRQIEAFAENAEKWLGEDGSLPGIFK

SEQ ID NO: 5396 - protein, 43 aa, Bacillus licheniformis
MGFCCGGYGGGYSGGYGGGYGSTFVLIVVLFILLIIVGASFKY

SEQ ID NO: 5397 - protein, 85 aa, Bacillus licheniformis
MDNQFFKNIEKKTGVSMNDVMQLANSLQNANFKDENTVRSVIKRVAKLANKRVPKEMEDKIVESIVSGKEKMDFNTIAKMMNSKK

SEQ ID NO: 5398 - protein, 759 aa, Bacillus licheniformis
MKCARFNNRDIHIHTYSREHLQFLFDEARKDRITCKYCGLPLRLKLSIHEEPHFFHRENGDFSQCEAACLNEKTEQKTKQNDYTESGVFRLPKGKAIGEEKKADTDFWTPPREASIHSPFSPAAETAPEPVFPNVPLNEKQLAAVTAPEEPLLVLAGAGSGKTRVLTARAYMISRLDIPPSAILLVTFTTKAVKEMKERMASLYGLPMQTVNRLVTGTFHSFFYKILYHHDPAKWNGEHLLKWEWQKEQYIKMALAEEGLDEKDFPVDQAIQQIGYWKNAYLPGEQIPLEDEWEKRVHRLYRHYEEQKAARRQFDFDDMASACWQLFQEQPDILKRYQTRFHAILIDEFQDINPVQYAIIKLLASPENNLTCVGDDDQSIYAFRGSSPSFILDFEKDYPKAKTVRLTTNYRSSHPIVASADMVVRKNKKRFPKTLSAARDDRQKPLLFYPYDEEEEAIMIVSDIQEKIEMGAKPDDFAILYRTNSSGRAIFERLHQSAIPYTAEQGVRSFYSRRIVRQMLAYLYLSQNQDDAEAVKQILPALFLKQSALNTLKALSITEDCTMVQALEKLTDIKPFQLDKIKKIVPFFPGLKTMKPVEAISFAEEKMGFSDYLKKRGNEGNKLEKGSDDLRDLKTAAKKFKTIPEFLEHVDHMRAAEKQKADGYGVQLLTIHRAKGLEFKTVYILGVQDGSIPHDFALETARKGDETALEEERRLLYVAMTRAEDRLYISVPSFRRGRTAYRSRFLQPILRPNPQVQLQ

SEQ ID NO: 5399 - protein, 191 aa, Bacillus licheniformis
MNDILMWLTDLGYFGIAIGLMIEIIPSEIVLAYGGYMVSNGSITITGAVIAGVIGGTIAQLFLYWIGYYGGRPFLYKYGKYLLIQKHHIQTAEKWFEKYGGGVVFSARFIPVVRHAISIPAGIAKMPILKFTGLTVLAIIPWSILFVYLGVQLGSRWDHVENVARTYTTPIMLGAAAMIILYFGLKKLRRK

SEQ ID NO: 5400 - protein, 328 aa, Bacillus licheniformis
MTSVLVTGGAGYIGSHTVLELTKQNRSVVVLDNLSTGHREAVSGVSFYEGDIADAALVKAIIKHHDVDAVIHFAAKSLVSESIEKPEIYFRENTLKSCAFFETAIKEGVNNIVFSSTAAVYGIPEKAPIKEAAPLSPVNPYGESKLMIEKYLHWVGKTHGVKWAALRYFNAAGAALNGAIGEDHDPESHLIPLVLQTALGQRKQLSIFGEDYSTPDGTCIRDYIHVLDLASAHLAALDGLYEDRLKQNVYNVGTGAGHSVKEIIETAENMTERSIAAKTDERRAGDPPVLVADSRTLVEDTGWKPQYSDLQTIIQSAWQWHKAHPDGF

SEQ ID NO: 5401 - protein, 296 aa, Bacillus licheniformis
MKVKKAVIPAAGLGTRFLPATKAQPKEMLPIVDKPAIQYIVEEAVQSGIEDILIITGRNKRSIEDHFDRSVELEQNLLAKGKNDVLKEIREIADMANIHYIRQKEPIGLGHAVLSAKHFIGDEPFAVLLGDDIMVSETPALRQLLEVYEEYQTEVIGVQPVDPADVSKYGIIQTSAQKNKVYQIDDLVEKPTVKDAPSNIAVMGRYVLRPSIFPVLEQTKRGAGNEIQLTDALREICREQSMYARKLKGSRFDIGDKLGSFKASTEIALMRDEMRPKLLAYLESVLKKEAQKGAWQ

SEQ ID NO: 5402 - protein, 131 aa, Bacillus licheniformis
MNKKNIPTLVRFGTVGAGNTLVDFVVFFLLTSLHVPYLAAQLFSYSAGVANSYIWNRTWTFQVKEKAHGAEIVRFIMINLAAAGATFVLLYIFQKAGLSLFISKMSATVAGMAINFTGNKLWVFQEPGTDS

SEQ ID NO: 5403 - protein, 139 aa, Bacillus licheniformis
MEAVIVKNQQQLEDAFFVRKEVFIKEQHVSPEEEMDHLDQESSHLVIYDEKEPIGAGRLRLVDGYGKLERICVLKSHRSLGVGNLIIQALEEEAAKQGASQFMLNAQTQAVPFYEKHGYKVVSEEFSDANIPHVKMVKK

SEQ ID NO: 5404 - protein, 169 aa, Bacillus licheniformis
MKYGIVLFPSKKLQDIANSYRKRYDPNYALIPPHLTLRTPFEVSEDEISGVVRHLRELSKELKPVTLKITKFSSFAPVNNVIYMKAEPTEELMQLHEKMYSGVLEDKPEYAFVPHVTVAQKLSDDEHSDVLGTLKMRDASHEEVIDRFHLLYQLDNGSWTVYETFILGA

SEQ ID NO: 5405 - protein, 238 aa, Bacillus licheniformis
MKTGVIQEKKLFSEELGEEMELLVYLPSSFSPLYKYHVIIAQDGHDYFRLGRISRQVEELLANGEIERSIIIGIPYKNVQERRLTYHPEGSKFEAYKRFLANELVPFTDREYPTYQVGSGRTLIGDSLGGTVSLMTALDYPNMFGNVIMQSPYVDRHVLDKVKQSDSLQLISICHQIGEKETAVKTTDDQILDFTGPNEQLKELLESKQTNYDFKAFDGDHKWTYWQPLITPALKKML

SEQ ID NO: 5406 - protein, 162 aa, Bacillus licheniformis
MNQVQALRGDLFHELETGIRSTCHLLKKVKESDWSYRPADRMRSLKELASHLTAIPEADLAIMQEKEEDVIARIEKKYGALQSADQMAAAMQKGFDAFQTYMTSLSDEDFLTKKTKPFYLDEGMTQSRWLTETLTHIFHHRAQLFNYLKQLGYDVNMFDLYL

SEQ ID NO: 5407 - protein, 315 aa, Bacillus licheniformis
MPKTERLIELMMTIHTKRKFTAGELAVEFGVSYRTVLRDLDELSALGVPIYSETGANGGYYLLNEPVLPPLFFTQSEAAAMFFAYQSLQFFGSLPFDAETRMVLKKFYRHLPPETQERIDAMKDRIVFWNPHRPKAAEHLETLLDAAVTQSVLTVVYDGTDECTERSIQPIGLYSWNGFWYCPAYCFKRQAFRLFRADRILRAEKADSGQARQLPYPSVLSWIKHSESECPEPVRLQAELTRRGARRAAADVDLFKILTMRDDGTGAIDASIPRSELEYFGELLWNLGAEVTVTEPAEIKLHLKRKAADILARYG

SEQ ID NO: 5408 - protein, 374 aa, Bacillus licheniformis
MTEHVQTTLAQIGNRSDEITGTVNPPVYFSSAYRHKGIGESTGFDYIRTKNPTRQLVEDAIAKLEGGTRGFAFSSGMAAIQTIMALFQSGDELIVSSDLYGGTYRLFENEWKKYGLRFLYDDFSDEDCIKSKITDNTKALFVETPTNPLMQEADIQKIAQIAKENDLLLIVDNTFYTPVLQRPIELGADLVIHSATKYLGGHNDLLAGLVVAKGEELSEEMFQHQNAIGAVLSPFDSWLLMRGLKTLALRMRQHQENARELAAFLEEQEEIADVLYPGKGGMLSFRVQKEEWVNPFLKNLKTICFAESLGGVESFITYPATQTHMDIPEDIRIANGVCNRLLRFSVGIEHVSDLKQDLKAALEKVKGEAVPHES

SEQ ID NO: 5409 - protein, 391 aa, Bacillus licheniformis
MSHENWTLETKLVHNQNKTDGATGAVSVPIQHASTFHQDSFDKFGEYDYSRSGTPTRKALEDTIAELEGGTRGFAFSSGMAAISSAFLLLSKGDHVLVTKDVYGGTYRMITEVLSRFGIEHTFVDMTDLNEIALNIKENTKVIYLETPSNPTLGITDIRGVVKLAKAHGCLTFLDNTFMTPALQRPLELGVDIVLHSATKFLSGHSDVLSGLAVVKDKKLGEELYKLQNSFGAVLGVQDCWLVLRGLKTLQVRLEKASRTAQQLAEFFEKHPAVKQVYYPGLSSHPGASIHKHQANGAGAVLSFELEDAEAVKQVVENVSLPVFAVSLGAVESILSYPAKMSHAAMPKEERTKRGITDGLLRLSVGVENADDLQADFAQALEAVSGALARS

SEQ ID NO: 5410 - protein, 396 aa, Bacillus licheniformis
MNSSLISPDDVWVLWGFIAVWAAVSIYLEQRFRWAAAVSGAVLALGGSMLFTNAGILPAESPFYDAVWSYVVPLAIPLLLFQINVRKILKESGRLLMMFCISALGTAAGSVIAFFLFKDQIPHLDKIGGMISASYIGGGVNFAAMAAKFSTPGEYVSSTVVADNFMMAFLFFILMGIPALTWFQKRFGVQEVAGGRENQAEAYWKRKDISLQDIALNIGTAFAIVAVSVKAAAFFKERFSSDGGFQFLAFILGDQFLLLTTLTILLTVVFPRYFERLRGSQEIGTYLIYLFFVVIGIPADLRIILMNAPLLLAFVFVIAMSNLLVSLFCGKLFRFRLDEILLACNASVGGPTTAAAMAIAKGWRGLVAPVMLVGTFGYLIGNYVGTFLGTWFSTLL

SEQ ID NO: 5411 - protein, 189 aa, Bacillus licheniformis
MDINGLINELHLMQQSYATLFSVVNKVQTRGDEYMEILTARQHMALIAIAHLPPETATLTNISKKLGTTKQTANKLMTGLVKKGYVKSVPSQKDKRSINIEMTAEGKKALVECSERSVYFLADLFQQFTSEEVATFWRLLQKLYRFDGEEHDGFEENANIQLGVGNSLDTERILGEFEKRRYGGENDEK

SEQ ID NO: 5412 - protein, 457 aa, Bacillus licheniformis
MKQNKREQLVNLFSVLKEKGQINAAVLVAEDGDILYQGAFGYENLADKRLLQEHSLFELASLSKPFTALGILQLAQQGELKIEDPVERWITGFPYQGVTIRDLLTHTSGLPDYMEWFLQHWDHNKIAVNQDIVDMLMNHHPQRYFAPGEGWLYSNTGYVLLAVIIEKASGLSFAEYMKKNIFEPVKMRNSRVYNRRLQPETIENYAYGYVYDVHTAQYVLPDDLEETKYVCYLDGIQGDGTVNSTIHDLYLFDQALYTDCLINQVSKELAFSPASLKNGESIDYGCGWVLRDSPETGRIVGHSGGWPGYSTVMIRYIDQQKTFIYLSNVEQDDEYEQAIFEAVENILFDKAYKIPDRPADKKKKEIDPAIYKRYVGSYSLQDGTAADVTVDKGRIYMQITGQIRFELFPASETRFFLRSLSVEVEFILEDGVATRLIIYQNGAEEEAVRIVEANSKV

SEQ ID NO: 5413 - protein, 316 aa, Bacillus licheniformis
MAKTIISGFILFFLLIFSAAEPTSAAFWDTKGDNIIHDPSMIKEGNTWYTFGTGIGNGIRVIKSTDGKTWSAAPSIFATPLSWWKKYVPNHEENQWAPDISYYNGRYWLYYAVSAFGSNTSAIGLASTDRISSGNWRDDGLVIRTTTSNNYNAIDPELVIDKEGNPWLSFGSFWSGIKLTKLDKKTMKPTGKVYSIASRPNNGGAVEAPSITYKNGYYYLFVSFDKCCQGVNSTYKIAYGRSTKITGPYYDKSGKKMTEGGGTILDSGNDQWKGPGGADIVNGNIIVRHGYDALDNGAPKLLINDLNWDSKGWPKY

SEQ ID NO: 5414 - protein, 59 aa, Bacillus licheniformis
MDLILKSVDSILIVFLAIFFMWKFVYEIKHEKRKAVILLLLLINVYFIVKVFNLVLQLM

SEQ ID NO: 5415 - protein, 192 aa, Bacillus licheniformis
MKTEKQKMLDGELYHASDPVLCHDRLKARKITNEFNHSNEIDDNKRTKLIKELFGSTGETILIEPSFRCDYGFNIHVGENFFANFDCVFLDVCDIRIGDHCMLGPGVHIYTASHPLDPSERISGAEYGIPVIIGRNVWIGGGAVINPGVKVGDNAVIASGAVVTKDVPDNAIVGGNPAKIIKYVDSKNTNSM

SEQ ID NO: 5416 - protein, 119 aa, Bacillus licheniformis
MKWLGKSLVASSLLAGILAVSGSPMHVQAQELSKTENLSSHAFAQGIIAPQAIVINRQMRVGQEDQYVGISNVSYSGSAITVRITSDRVYVKAVSPGKATFSYLNSLGQLVINNITVTR

SEQ ID NO: 5417 - protein, 296 aa, Bacillus licheniformis
MHYDALKTFVTLAEVKNFTKTAELLLMSQPSVSMHIKNLEKEFQTKLFERSPKYLKITPTGEILYDRAKQMITIYEQTRQDILDHHNSIKGELKIGASFTIGEYILPSLLFDLQKEYPELELKAVIGNTEEIVQSVRLYKVDIGLIEGQTNEKELSVHAFMQDELFIAASSDHPLAAKQDVTISDLQNQTWVTREVGSGTREYLNHVIRSNGLKVKSFLTISSNQGIKETLMTGIGLSLLSGSVIERDVQHGNLSVIRLKNQTFNRTLSYIYSPVMQDKKNVKTFINALNKRTSSK

SEQ ID NO: 5418 - protein, 609 aa, Bacillus licheniformis
MQLQVMNSPFNQEQAELLNRLLPTLTASQKAWLSGYLAAVQTADAAAALETLPAEAPAASPAQPVSKEVTILFGSQTGNAQGLAENAAKTLTERGFQVTVSSMSDFKPNQLKKLKNLLIVVSTHGEGDPPDNALSFHEFLHGRRAPKLDDLRYSVLALGDTSYEFFCQTGKEFDQRLGELGGTRLHPRVDCDLDYDEPAAAWLDGVISSLNEGQEQGASAAPAQTAAPQAAGGVTVYSRKNPFRAEVLENLNLNGRGSNKETRHLELSLEGSGLTYEPGDALGIFPENDPELVDMLLKELKWDPNAAVAVDQGENLSLKEALTSYYEITVLTKKFIQQAAEIIENEKLRELAAPENADQLKAYIAGRDLIDFVRDFGPIAAAPQEFVSILRKIPPRLYSIASSFAANPDEVHLTIGAVRYNAHGRDRKGVCSVLCAERLQPGDTLPVFIQPNKNFKLPENPETPIIMVGPGTGVAPFRSFMQEREETGASGKSWMFFGDQHFVTDFLYQTEWQKWLSEGVLTKMDVAFSRDTEEKVYVQHRMLEHSKELFEWLEEGAAFYVCGDKNNMAKDVQNALLEIIEKEGGKSREEAEAYLAEMKKQKRYQRDVY

SEQ ID NO: 5419 - protein, 572 aa, Bacillus licheniformis
MGNEILKAPEGPPSDVERIKKESDYLRGTLKESMLEPLSAGISDDDNRLMKHHGSYLQDDRDLRNERQKQKLEPAYQFMLRVRMPGGVATPEQWLVMDELARKYGNGTLKLTTRETFQMHGILKWNMKKTIQSIHSAMLDTIAACGDVNRNVMCTSNPYQSEIHREVYEWSKKLSDDLLPRTRAYHEIWLDEEKVAGTPDADEVEPMYGPLYLPRKFKIGIAVPPSNDIDVFSQDLGFIAIVEDDKLIGFNVAIGGGMGMTHGDKATYPQLAKVIGFCKPEQLYDVAEKTITIQRDYGNRSVRKNARFKYTVDRLGLETVKNELENRLGWSLAEAKPYHFEHNGDRYGWVKGVKGRWHFTMFVEGGRVTDYDDYKLMTGLREIAKVHTGDIRLTANQNLIIANVTSQKKKKISELIEQFGLTDGKHYTALRRSSIACVALPTCGLAMAEAERYLPKLIDKIDEIVEENGLKNEEITIRMTGCPNGCARHALGEIGFIGKAPGKYNMYLGAAFDGSRLSKMYRENIGEEEILKELRNILPRYAKERNEGERFGDFVIRAGIVKETTDGTNFHD

SEQ ID NO: 5420 - protein, 166 aa, Bacillus licheniformis
MVINMNSLHIFVKVAETLNMTEAANELYISQPAVSKAVKSLETSLGVKLLIRDKQNKIKLTDAGKEIVVLARQMIVIENKIYQVADQENHLLRGKVKVGSFPAVSANILPQAIASFRSKYPLVQIELLEGTSDQIKQWVETRMVDLGIVASPFDGFESQPDDGRDS

SEQ ID NO: 5421 - protein, 290 aa, Bacillus licheniformis
MFKVLLGIISVTLIWGYTWVTMKIAITDIPPVLFSALRLFIGAVPLFVILLIKGRKRSIGKENIKHYLVMSLLMGLGYMGVLTYGMQFVDSGKTSVLVYTMPIFVTVISHFKLNEKINVYKMLGLFSGLIGLLFILGGGILHVDQNVIFGELCVLIAALSWGVANVYSKLKFKNTDMIHMNAWQLLTGAVMLLIFSFILEPSRPIHWSNEAILSLLFNGLFSTALTFVIWFWILNQIEASKASMALMFVPVLGLLFGWLQLHEPVTFSILIGAFMICIGIFMNTYQFKKV

SEQ ID NO: 5422 - protein, 125 aa, Bacillus licheniformis
MKIEHIAIWTNNLEEMKDFYTRFFHGKTNEKYVNPKKHFESYFIQFESGTRLELMRRPDLAKGEENASGYAHMAFSLGSRQEVDEMTSRFEKEGYQVAGKPRVTGDGYYERVILDPDGNIVELTV

SEQ ID NO: 5423 - protein, 182 aa, Bacillus licheniformis
MKKLIVCLLAVLLILPAGASLAAKNQTSGNLTNKQVMQLTLQAREHFWNTMSGHNPKAKNSTCPSKTFEYRGLPYTYMCSEFSTKAKLTDYLTPVFTKDAIKKGLEKYNIISYKGKMAVPVGDGDNLLGWDKAKIKLISQKNNTRTYEFSVPALDGSVTAKRKITFVKENNKWKINQLDAAI

SEQ ID NO: 5424 - protein, 244 aa, Bacillus licheniformis
MKKTIMSLAAAAAMSATAFGATASAKEIEVQKGDTLWGISQNYGMNLKDLKKWNQLSSDLIFPGQKLNISSQEEKSEEKQYTVQPGDTLSKIAKEFGVTVSDLQKRNNLKSDLIIAGQTIAINGEAAAAAAPVKQESAPKQNDQPVNVQKEITVTATAYTANDGGISGITKTGVDLNANRNAKVIAVDPSVIPLGTKVYVEGYGEATAEDTGGAIKGHKIDVFIPDKKDAFNWGVKTVKVKILN

SEQ ID NO: 5425 - protein, 474 aa, Bacillus licheniformis
MEQARKGSFMIIAILIVGNFLALINETVMNVALPKIIDDFGISANTAQWLSTGYMLMIGIAVPITAFLMQRFTTRQLFLSAMTLFTAGTLLAGIAPVFPLVLAGRIIQGSGTGLILPLVMNVILTLIPPQKRGTMTGILTLVILFAPAIGPVISGYIVEHYSWRVVFFMMLPVSVFMIFYAAFRLKNVTELTYPKIDILSILLSTVGFGGIVFGFSNAGEAAGWSSPKVIIGLAAGVIGLILFVMRQLRLEVPMLDMRPFRSKIFSISVILMWIVMMLQFSMMLILPLYFQMALELSPLYTGILMLPGGLVLAMTSLVAGRLFDKLGFKPLLITGLIIVIAVLSLFTNISSDTPMAVGMMLYAGFTLGVGLTMAPIMTLGLNQVPKPLYPHGSAIMNTVNQVSGAIGPALYTTILTTVSNRFIAHSSGGSRQELHMQGMTEGVHMVYFVAIAFAAAALAISVFVKSRRAEQHAA

SEQ ID NO: 5426 - protein, 192 aa, Bacillus licheniformis
MAEKMSSRDKILRTASRLFRKQGYHATGLSQITAESGAPRGSLYYYFPGGKEELAQEAIQLTGERIKAYISSAISGEADPVKAFQSYIQMMADGIEEYIIEENDDIPIVSVAAETWSFSERLRQTCEQVYQDWQLVYQEKLLQSGYAPETAETLSVAIQAMIEGAYVLSVTKKNGRPLSAAAEQIPFLLKRS

SEQ ID NO: 5427 - protein, 111 aa, Bacillus licheniformis
MTFIILMAGLFLLIQLKRPFRRKMFGYVFLAVYLTALALYTINSAFVHFISDSLLSILAAIAVAPAACRLSEAFSGFPLNRIWTNRPYFKTGLQKRSFFSLKLYRPISIKS

SEQ ID NO: 5428 - protein, 137 aa, Bacillus licheniformis
MIKKTLGTMFAVTMIFLLILTVFTLFFGSYYFGVAGFFAIFGVTYESPWSLFWYILLSFGLGALFEIPEKILSFMIGHKAATFMIECFFTWLAIHLADELMDSITIPLDVEIIACLFLFVIHLAFEDNKERNRTYED

SEQ ID NO: 5429 - protein, 682 aa, Bacillus licheniformis
MKTLDVQALHKAIDQTVEQLKQQSEEIVNIKKSVEGITSLNDALKGKGGDAIRNFYKECHTPFLQFFETFIEEYQSALKKIKSALNSLEPQHNGYISQAFLDNELEQGVKDADRTTKRLVSKTNATIAKVSHIVDLPELDDSNFHENYSKALKEINQTIEKLHTFDREQTNTIKAAENDLETMQRYIARLEKMYTGPKIEITGYQKGSILKQDKMDTLSGNQETAMGVMLAKLDKRSKLEKEVSEANKQVNKISHLKEKLENVIDPDEFVEIAQEIGIENLTEKQQNYYFYTINRKRKQSGIMGRIKQGIEEGIEDVAVDTVTGIRDTITNPKETLEGIAYTVTHPVETFEIIKKDIEDSFVRDVINGDAESRARWFTYATGMVASSIVGTKGADKVSKLAKAGKMGKAASKIKDVSKKTASKGIESAKKAGKKAADKVVRDFKDIKNLTPKVQIASPQLALANAGKVPFNTIDGSRLKDKLIQQTKKISDQAKQARNRMVSIIAGVSSKTKTDIKVDSKTIHKVKYGDHFTRVKRRKVLKPNIEYTTPVGYTYKTDHKGRITNVSGKLNLGAAKRNKYAQRIAGREDRLKTDEGGHLIASIFEGSGKLDNLVPMDGNLNKGEWKKLENMWAKHLEKGRTVEVKIQPVYKGNSQRPASFEIEYKIGKREWEVVKFDNKPGGK

SEQ ID NO: 5430 - protein, 215 aa, Bacillus licheniformis
MKRALTDQYGSFTEMAENEIEGTDYSVAARDAGSALLVMAPHGGGIEPGISEIVKAFAEGASVYLLEGLKRRGNKSLHVTSAHFDCPLALRMAAGHRYILAFHGYEEPAHRHTLIGGTDRRRALMFKETLERHGFSAELAAERGYLSGTNPASINNRCQTGLSVQFEISTAQRKAMFEQFTLKGRRTSQNEVFSRYVKALKEGACIAYGPSAAGS

SEQ ID NO: 5431 - protein, 218 aa, Bacillus licheniformis
MKFYLSHLEEYVKNMYQKFGFFEPHQIDMNRIAAHFNIWIHYENVNSMMIKHDGMYSIILNSSLSKEKQWEDFAHELCHVLKHAGNQLYMNQMFRELQEFQANQFMYHFCVPTFMLLKMDFPQLRCQAAKMIADLFKVTESFAVKRIELFEKRQAGIQFHEAWMASLSQESESANAPRFEEVDELARYRRETRRPYAAANGLGKMVAAESRPAYMLRK

SEQ ID NO: 5432 - protein, 117 aa, Bacillus licheniformis
MLGGRLKSLRGKRTQEEVAKQIGVSRARYSHYENGRSEPDYETLKKLADYYKVTIDYLLTGTEKKKNIEDEIADPDLQIAYRDMQEFSPESRQQAIEFIQYLKEKEKKRKPGDKQNG

SEQ ID NO: 5433 - protein, 68 aa, Bacillus licheniformis
MSERLGLSEVYVRKIERGTRNPGRETMLKFETLYSVPDRLLFPDLFQVFIDTYCIKENLHKRRRCHES

SEQ ID NO: 5434 - protein, 98 aa, Bacillus licheniformis
MNLEHPMVTRIRTHGYPKEADREQMRSHGGLAGYPKGGSMGKIVISYSSDRFDQWRLGEAGGFNAFTKDGKPVFQFDHKGQYERYLRLNRKRQKEGGR

SEQ ID NO: 5435 - protein, 276 aa, Bacillus licheniformis
MSRPPDQSYPFSVYSGLLTPVHYEKIGNAIWLFLWCISSTTKEIERDGETWGIVLGNKPLKAAELALQFGVNEKTIRRWLALLERNGYIAVTRAPYGMILSVRHSKKFAYASHVRTELPDRTEETGSADKLVQSNKDITQINTKHNMSSIKTIAERFAALRSMQEGKPVHPSSKDYQAIARIVARGVSLPQTIKWLEQCFEEYEARRRSRHETIKVFSYCEKYIIGRLAEAEAKTKTTVRRENNAQKNNRRGHGRTEKQEPSITGGQTGRIRRKTV

SEQ ID NO: 5436 - protein, 266 aa, Bacillus licheniformis
MPKRTIEEVMDELRNRSRQSQGGKPEESAAKRYDCPKCKDELGFIERRGTMEVWVSCVCREWRKAQKLLKTSEITEQFKNLNFAQFKTEGKHQSVKEAYECAVEYVQAYRDIQESRRNSIALLGRPGSGKTHLLTAAANELMRKLFVPVLYFPFVEGFNDLKQDFSLLENKLNRMKQVEVLFLDDLFKPVAGRPRATEWQIEQTYAVVNYRYLNHKPIMLSSELSVEEIVSIDEALGTRLVEMCGDFLVVLNGSSFGINHRLEGMV

SEQ ID NO: 5437 - protein, 113 aa, Bacillus licheniformis
MKNESEAYSPSPWRVVRTNTDVYIYSAYSKAEKKRFSYSNGRVIAKVADYSAYSKEKNARLIAAAPELLTAVKLTLAYLKRKRPVHSDSVENQLKNILEKVVAKAEFEEEETR

SEQ ID NO: 5438 - protein, 67 aa, Bacillus licheniformis
MNHPAKLTDINDTTVASRIKKGKVTVIVLDGMNGTAWQAEAPEHGKTVIETRKGDLARIEFEIGYKL

SEQ ID NO: 5439 - protein, 167 aa, Bacillus licheniformis
MEDLLFEYKRALKNTKKLYKPYQDEQGLTAEQLNDKKLIRNMMTDLEYVIDWLENGREPGIRRAIDRRDSYKRMLLKDPRIIDTFSEQSAFEPAQEVSAYDKARIESALSALTAREKEIFILHKVEQFSYERIAAMLGIKKSTVQTNVKRAQLKIAKQIEKPLDCMA

SEQ ID NO: 5440 - protein, 266 aa, Bacillus licheniformis
MPRKRDPKRDEAFRLYQKYGGNITNLAIARELGVSNKKISVWKTRDRWQEALAGDDANRGKADIHNEGLNERQRLFCIYYVKSFNATQAAVKAGYSPASAHVTGCRLLKNEKVADEIRRIKKEMVGEIFVEAMDVLQVYVKIAFADMTDYVTFGKKEVQAVGKSGPLFDEENNPVMKEVSFVDVKHSDLVDGTVITEAKLGKEGIAIKLADKMKALDKLSQYFDLFPDSFKRKIENEKLKLARQKADKDAETGPVEVVIARKGDQA

SEQ ID NO: 5441 - protein, 432 aa, Bacillus licheniformis
MIIKEVNPHFEDYLFNWDQTFQFLVGGYGSSKSYHTALKVVLKLLQEKRTALVVREVFETHRDSTFSLFASIIDELGVQKAAQAVSSPMHIRFANGSRIIFKGMDNPAKLKSVNNISLIWIEECSEVKYEGFKELIGRLRHPYHRLYMMLTTNPVSQSNWTYRHFFKDERNKRFILDDEVLYKKRVAVVGDTYYHHSTADDNLFLPKSYLKQLDDMKAYDPDLYRIARKGRFGVNGTRVLPQFEVMEHEEVMRQISAISNPLKRTGMDFGFEESYNAVVRAAVDPDKKYLYIYWEYYKNKMTDDKTAEELHEFAVAKELIKADPAEPKSIQFFRQNGFNMTAARKFQGSRLQYTKKIKRFKKIFCSDRCANTIYELQPLTYATDQDGNLKEDQFTIDPHTLSALWYALDDYEVTDLKAEPEVRKRPNRKRGR

SEQ ID NO: 5442 - protein, 504 aa, Bacillus licheniformis
MSTQQTVRAKVMKSRFHGPVTKQIYEDQFSEIYGDDIIAPPYNLKELKAIAEYSSILQQCIDAYKTNIAGFGLDVEYAFDFNGADVTPDRKKAAESDWTRLEDFCRHLHFDESAETILSHMIEDREKTGNGFLEVLRNGAGQPAGIEYLDVKNMRVCGLTEPIEVEFAYMENGSLKNIKREKRFRKYVQMIDGRKVYFKEYGDPRVMDMTTGEFDRQTPPERSANEAIHFKIGSGVYGVPRWIGNIVNLYGARKAEELNYMYFRQGRHVPAVITVENGMLSEASYRELQEYMNDLEGVENAHKFLLIEAEGIAQEKDIHGSQDITPVKVDIKSLAEILQEDALFLEYDEKTRNKIRSSFRLPPLYTGDAHEYNRATADTARKITEEQVFEPERKILIGKLNTLFLRDLNIFHARLQLKGPDFRDPLEIAKVLGPFIQAGAVSANDLRDLAGRVLGKTLDEWPEEEFSRPLVYQESSKRAEAEAGALLPELQEAVETLKQITERR

SEQ ID NO: 5443 - protein, 282 aa, Bacillus licheniformis
MPRELKNAKINFVSYVDKAANKKKFFMTKSSEPPTFQKEVKLIAKAEDEKKLVYGVVYEPDIQDAHGDFMTAEEIQKAAHGFLKNARKIDKDHNFQGGVGEVVESYVAPADFEVNGETIVKGSWVLVTKAGDEIWEQIKKGSITGYSMAGTAETVEHAPQADSETDEPGSFFQLFKQFFAGDKQKTGEEEKKMKRSEVQGTIEAVLAPLLKRLDDLEGDKAADEKEQQTDQDAHVKEIVEDMLAPLIARIEALEKMRGASKQAAAEKDGEEEVKKSIWSGLL

SEQ ID NO: 5444 - protein, 311 aa, Bacillus licheniformis
MRNQEIIRKAEMSLATLKSGGLMNPAQASAFIRMVQNTPTIFSESRVIQMENDSQKFEKIGFGQRILRAADEGKALAKDQLTAPVTSTVELNAKEVIAEVNITYDTLENNIEKDGLQQTLMQMLAERAAVDIEELIVNGDVASSDPYLAQLDGIRKQSVSHIVDAGGEQISRQLFKQGLKAVPAKYMRVPQEFRFFTSLGQEIEWKDRVAERQTTLGDAAVQGGLSTAFGVPVKGVSNIQPYAYGEGDAAAEASDIILTHPKNIILGFSRNIRIEVDKDIRARKFIIVLTAKLDSKFEEEDAVAKIINVKE

SEQ ID NO: 5445 - protein, 124 aa, Bacillus licheniformis
MLITPDDIIQYSVIEAVKNRPQELLRQDILEAEAEAEQITGHRFTDEKYDPLPEKARLALLQLAQYFALKNGDESLLKGYKSEKLGDYSYTLSRSGGLVKPDVYKLLEEFILDYESVRFKVRPL

SEQ ID NO: 5446 - protein, 118 aa, Bacillus licheniformis
MSYKRLLSDRCDIYHLKEDQAEEARYGIPARDLQPIRTYGETPDLQNVPCYFTEKNQSIVQQDPEQVIYHSYLAHFPAEADVRLHDKAVWNGVAYTLQQPRNIKGHHLEVLAVRDEKL

SEQ ID NO: 5447 - protein, 162 aa, Bacillus licheniformis
MKIKGLKQLSQTLEKAGQSGFRNEAAKWLEQAGTDFLDLVCDEIVRAGSIDTGSLLRSFKRGAEGNRWEIEKGGLTLEVGTELEYASFVNDGHWTGGKDEVRWVPGQWHGGRFQYDPGSSSGMALKRQWVKGTGYWEHALYIFERLFEKRLNERLQKWLNSL

SEQ ID NO: 5448 - protein, 146 aa, Bacillus licheniformis
MNDETGSVMNFFYQVFPVVCYEKEIPDHFQIPSLYFPPPSVFDENDTVSTFKKVFTLNVKLFHHDSQQAHDHAERIADAVREARHIIPLIDRSGKGTGDSLRISRIETRIGDSGTASIIIQWNSRYWYKRESELSLETIDFTNGVK

SEQ ID NO: 5449 - protein, 74 aa, Bacillus licheniformis
MAVSKKTNTEAKKAPQEEREALFYIEDLREHAKELFGIKPEVLDGALFHVKEEQISKPEASQLIQTFLAKEVMN

SEQ ID NO: 5450 - protein, 448 aa, Bacillus licheniformis
MNGGTFTPGKEKDRAGIYFNFKTTAEERVSIGDRGTVALPVVMSWGEPKTFVSISSIEDLNKKVGLNIDDPSLLLFREAKKNAQTVLLYRLNTGAPAKAQIGETLSVTAKYGGEKGNDISIRISENVLDSKKFDVTTFVGTDEADRQTVKTAEELTANAYVAFQGEGALELTAGTKLSGGENGTASVADYTAFLDAAETEYFNTIALPVADNEQLKATFAAFIKRLRDKQGQKVQGVVADYAGDYEGIINVTGGVVLEDGTEITPEKATAWVAGASAGATFNQSLTFVEYEGAVDVLNRLDEDQVIERLKKGEFLFTFDARDQSVSVEKDINSLTSFTADKNKKFSKNKIIRVLDGVNNDLTRELKALIKARKASGSDIPASDDGLQYVKTLIIQYMTALQEAGGITGFDSESDIAITLNEDRDGFLIDLAVQPVDAAEKFYFNVEVK

SEQ ID NO: 5451 - protein, 147 aa, Bacillus licheniformis
MALKAQNTISGKEGRLFLDGQEMAHIKTFEANVEKNKAEVNIMGRRMTGHKTTGANGTGTATFYKVTSQFVTLMMNYVKKGDDPYFTLQAVLDDQSSGRGTERVTLYDVNFDSAKIAGLDVDSEALEEEVPFTFEDFDVPEKLKDTF

SEQ ID NO: 5452 - protein, 149 aa, Bacillus licheniformis
MSEKQEEKVYDLSFFMPGQTVEAEEIKVPISKRFVDKKGNVIPFVFKPITTERIDELEKENTTYKNIKGRGRVKDLDTQRFYARIAIESTIYPDFRSKELREAYKTADPVEVAKRVLSVGGEYANWLNKAIEINGFEDDLEDLEEEAKN

SEQ ID NO: 5453 - protein, 1260 aa, Bacillus licheniformis
MAKLTARFELEDRVSKKLRRIQKGFAILEKRAERLNRQIKINIKTEDQAFFRLKKLNNYLMRKFIHSVNIGVNINDQASAQLIEIQRRLKRIPPETTVKLTLADNVSQKLTKIKRMLSKREYFLSISAEDRVTLTVKKIIGYLKNNLKKGYSVQLYVLDKVTKTASRIASLLKKLEKTYIVTIDLNDKATNKIKNKKVSGETSEVKHDKKGSFFEQGKDLLGEWWKKSGWPWIKDTGKEIGKAFVDRFKDRLMEKLNNDIFDKVIDKILGPQSTKGSQSKSSGPGHGQCCCCLYPQKDPPNSAGNRQNVSVSGSSEEHKGWNLKSLSRGILPAAKILFYLKSLRPNKEPGKLAKLLEPLKPMIEKLKPLGKKLSPLGKLLPLTDLIGINKDNAGEKIGSVGGRMLGTFGGEAAGMAIGGLVGGPPGAMIGGVVGGFAGGMGGEKAGGSLGKMFDTSQLKEDLMNTLFNGDWWSEQWDSLSQTATNTFLNGDWWGEKWGSLKETATNTFLNGNWWAEQAGYLYGTLEAAFLGPLSNVWGTIAGTISETIFNGDWWSEKWNNAVTWAQNTWDGAVSVWESITGTIKDTVFNGDWWSEKWNNAVTWAQNTWDGAVSVWESITGTIKDTVFNGDWWGEQWDNAVTWAQNAWDGAVSVWESITGTIKDTVFNGDWWSNQWNSALERGKSIFEGAKSWVGEKVEYFQKGRERAHKDHGFEGYATGGYITKPTISWIGEAGNEFVIPTENNRGRGKMLLAQAATKLGMRVVDDMGAAAGDGGASSPVSSTASYSASVSPAVGVGSIAAEAQAFGREFTGGFDKGIGSNAPSLDQWKQKNISKPFSSLPAESSNYGKQTVAGFASGQNASATGTGGFLQAKVNAPYQTTVKTSSSWGANTVKNFATGQNATPTGTSQYVDKNINKPFLDSKQSAAGWGSGMVGHFISGMNGKGSEVSQAAKNLAKKVEKAFREELDIHSPSRVMMSLGRFASVGIVKGLSSVDVKSFAEKQAGSLAAAFSGIGAVGGNVKSWLMQAIMATGSPVSWLQPLSVIAQKESGGNPRAYNGWDINAKRGDPSRGLMQTIGQTFNAYKGKGMNDIFNPVHNAVAAINYIKSRYGSPFNTPGIKSMARGGAYKGYANGGLITSEQIARVGEGGKREWIIPEERGIRGRYLLQRAAGALGMEVQDPAEGSGSISSAQAAAATTGGTRSRQPAENGAKEVNIYITGDNHYHSERDQETLIAKIKRALVDELERDIHIGTKGSVAYD

SEQ ID NO: 5454 - protein, 218 aa, Bacillus licheniformis
MTKSVYEFWLTQGKEKLRLPVLPEQLDVSNNLANESVKVSKFGEVTFINEPGAKTISFSSHFPKKYSPLSEYKGFLSPENAILKIEKWMKAKKPVQFLVTGTKINFTCSIENFSHREGEKDIGDRDFDLTLKEYQTASPRKIKQKKKTKKKRPSKLAPKMYTVKKGDTLWHIAGRFYGNSQEWRKIWNANKQAMIKRSKRNIKQPGHWIFPGQKLKIP

SEQ ID NO: 5455 - protein, 326 aa, Bacillus licheniformis
MIELFVIKESEWYELVTESVTLEGERYQAPRSIEASIVIKQGSHKYYSVQEGDTVLFKWKGKELFRGIVFSRVPKEYTLTFKAYDMLQYLVKNQDVYVFSNKTAADIVKRIANDFQIPKGSIANTGHTIKSLVFKDNTSLYDIILKALRETKKQTGKNYQLYAEKGKLCLRAWPEPEDIWVLETGVNITDYAYSTSIDETATRVKLRKQKDNKTYTASASDEAGMKRFGVLQYTETVSDDINEAQLRDRAKKIQAEKKGVKKELKSIQAIGIPEVQSGLPVYISIPEAGIKETYWVDKDKHDFTGTKHVMTIDVVAKNTIPEGASS

SEQ ID NO: 5456 - protein, 102 aa, Bacillus licheniformis
MKLSDAIKELALGAVNAESPVDVMPAEVVSASPLKLKLRNHDKLVIPSDLLVVARHLTEHTEQIRIDGEDKTIRFYNQLHAGDHVMIAAMPGGQSFFVIDRV

SEQ ID NO: 5457 - protein, 141 aa, Bacillus licheniformis
MALSPEVSFEDIEDDSDVIETSKTYKIDFETGRMTGDMISGLEAVEQMVCMALRTERYAYAVYSHNIGNELQEVLSDHETTDAYKEMEIPRLIEEALIYDDRISAVTDFEIERQGDAFHVSFSVETDEGTLEIEEVIGEDV

SEQ ID NO: 5458 - protein, 347 aa, Bacillus licheniformis
MFEDQTFEEIMERMLERVSDEIDKRENSVIWNALAPAAAELALSYIWLDQVLNLVYADTAEGEYLDRRAAEAGLERYRASKAIWSAAFTDGVSVPPGTRFFLEDLYFTMLEDGKLECETAGTKGNANFSGRPLLPLDTIPGLEKAVMGSLEIPGRDEETDESLYERYLIRVRREAVSANQLHYKQWAEEVDGVGKAKVFPLWNGEGTVKVVITNAKMEPATDALIERVKQYIDPDPGKGEGMAPIGAYTAVESAVWKDVSISAKIIPESGRTIGEAKQEIAEKITELFKEMAFKESVIRLSQINNMIYESSSVSDYSEVFINGEAKNLQLTETEIPKLGQVTIIEQD

SEQ ID NO: 5459 - protein, 306 aa, Bacillus licheniformis
MSKIDEMAFHLPPYLMEIREIQEIITAEAPEFERQNQEIFDMTDQLFVTTATWGLDRWEKILNVRREASDGVDIRRARLLTKMSNIPPITSRSIERAVNAFLKQPSASVRLTAGRYHFLLSVNGEDLQFIPSIIQTVNHMKPAHLAYTFRGGFHYECRPPKSVHDRLVLRSKNGFFGTIPVYLDGQYLLDDAFYLNGFREIDGLPRRFKQQLTLRHKKRQYIRSASSFTIKTAAENRRKQQTKAGMKTGITNQNKKVQSFKISCKCEHEFKQAGALEMREKWWTLNGAFLLDGTKQLAAAAQKIAL

SEQ ID NO: 5460 - protein, 128 aa, Bacillus licheniformis
MAQQLTVTTLYARQQMAKARAEGGKLTKITKMAFGNGGTNDKGEPVPLQGNEQALKNELLQKDIDGFAFMEPAKVRYTCTLGESELAGETINELALVDEAGKFTAVRTMTDKQKDGDIEFVFEIDDIY

SEQ ID NO: 5461 - protein, 401 aa, Bacillus licheniformis
MDIQKPRRFETTDRAHADLFNEAIDQLNVNDERIAKRAEEAEERAKTYTDAHANDHSIHITDKEREKWSAGQLYKITENNGKVFYRGSSETTDFNTLTETGMYLIYNEGINSPPSSNRIFLLVMSFGNTLVQAAYESYKGTQSYFRFRKSDSTTWTPWQTQETTSGAQAKVDAHEQNTNLHVNEDEREKWNNAQLYKITDNNGTRTKLPDGTDLLTLPTGFYYAMGHVVQNNPVENDSSWFNYDVIETGAGRKTIHAWRSYDNTLWHGTVHTDGQFREWKRVVTNADLNVAWQTPTLTNGWKQYGSHKVRFCKNMLGEVEIIGSITGGTIGFDIPAFTLPEGFRPIQAMYFIGVASSIGTGSIPQIHRTLIDTDGRVCIQSSSNTVNPNEFITFGFKFRAA

SEQ ID NO: 5462 - protein, 319 aa, Bacillus licheniformis
MDIQKPRSFRTTDRAHADLFNQVIDQLNANDESIAQFAAEAEQRSTAYTDAHISNKGNPHGVTKSQVGLGEVINKRQATKDEFDLHHNDQTRHVTEDERNKWNGSQIFNITGDNGQAKVYISAEDDFQTILPQYTGLIHFTAASGAINGPGAAVRGIWTCNALGNYGQAIAFDNANRTYRKTIAGGNWTDWTELISAESLEAKLANLTWHFPTLLNEWVNYADSTKVRYTKDATGTVFVEGAIAKGKIGFNIPAFVLPKGYRPSRAFQFVGVASQLGMSNTPQYHRLQVSVDGNVVIENCSNTVNPNEYISLGFSFKAA

SEQ ID NO: 5463 - protein, 89 aa, Bacillus licheniformis
MPEAPELDIFQKEVQEMKADQKSLEQRVSTLERTSDRHDQQIISINEKLNKIEENTTWIKRSITGAIITAVSTGIIGGAIAVFYNLLQK

SEQ ID NO: 5464 - protein, 87 aa, Bacillus licheniformis
MKHIDKGTVVRTVLLFIALVNQTLIMFGKPVLPVAEDQIHTLADALYSAGSAAFTIAASLVAWYKNNYVTSKGKMQKEVLQKKGLTK

SEQ ID NO: 5465 - protein, 354 aa, Bacillus licheniformis
MVKVINNFVKVNQYTRPGLKLAAVKGIVMHWTATPGASALNERNYFNGTCIADKRYASAHYFVDRHEAQHIIPDHEVAYHAHDQNRCYVSFLKPNANTTALGVEMCVEKDGTIHEETIRNAAELVADLCKTYGLSADRIVRHYDVTNKGCPTPWVRDAGQLSAFRKRVDSLLGRKTVSVSAASTSQTSSSSGIILKKGMSGSHVKKLQTRLVAAGFSLPKYGADGSYGDETVHAVVSLQKKAGIKADGIYGPSTEKALSAAEASAAGKSKTWTLPDGIYKVKNPLMKGTAVTQIQTALAALYYYPDKGAKNNGIDGYYGMKTANAVKRFQLMYGLGADGIYGPKTKAKMLSLLK

SEQ ID NO: 5466 - protein, 225 aa, Bacillus licheniformis
MKMKQLNPRSVRDQIYQVLKEEIMKFRLVPGEQISEKEISERYEVSRTPVREAFLQLSKEGLLEVYPQKGTRVSLIDLDLVEEARFMREKLEKAVAELACEDFPQEAMFKLEQNVKMQELSIAQKNYESLFELDEAFHQTIFEGCGKANVWAAIQQMNVPFQRIRFLRLAADFNWNTIHQQHAALTEAIRTKQKAKAKEIAEEHLQLVIVDKQMLIDEFPGYFKK

SEQ ID NO: 5467 - protein, 338 aa, Bacillus licheniformis
MKAAVMTKPYSIEFHDIPRPEPASGEVLVKIKAAGICGSDVHFYDGSNPYAQYPQIFGHELAGIIEKTGAGVRGRSAGERVVIEPAIPCGGCYPCRKGRTNACMNIDMIGSVRRGGFADFIIVPETHVHPIPEQMDFATAALCEPFSIGAQAVRRADIQTGETIVILGMGPIGLTILAQVKKRFDVRVIAVDPVRERLELAEAFGADAVIQPGEEDAEQMILKLTGGEGAGIVFEAAGIPATIEQSVRLAAAAGRIVIVGLTGRNVTIPGLLLTKKDIEIYGTKHSVNQFPGVIQFLNENPEIARAFVTEIMPFMEIEEALKKAKNCPHQVTKIILSY

SEQ ID NO: 5468 - protein, 365 aa, Bacillus licheniformis
MKMVFRWYGEGNDSVTLEQIRQIPGVEGIVWALHHQPPGEEWPLEEILEVKRQCEQHGFHIEVVESVNIHEDIKLGLPTRDLYIEKYKRTIENLAKAGVKVICYNFMPVFDWLRTDLYKKAPDGSTALFYEHAKVHTIDPFALVDQIAKHPEFTMPGWEPERLEHLTRLFEAYQNVTEEDLWSHLHYFLERIIPTAARCGIKMAIHPDDPPWPVFGLPRIMTSGESIGRLLQLVDHPANGVTLCSGSLGANPENDISAMIHAYADRIPFAHIRNVKVYENGDFIETSHRTKDGTVDICGIVKAYHETGFSGYVRPDHGRHIWDEKCRPGYGLYDRALGIMYLWGIWDSLNREKQEASKCLKSMKI

SEQ ID NO: 5469 - protein, 282 aa, Bacillus licheniformis
MLEIHENLAGKTAVITGGSGVLCGAMARELGRQGMNVAILNRTVEKGELVAEAVRKAGGAAIAVECDVISQRSVEQAKRVVADRFGGCDLLVNGAGGNHPNGTTSDETFNSEHIFQDNIKTLFDLNCDDVGSVLNLNFLGSFIPTQQFAKMMLNQKGASVINISSMSAQTPMTKVPAYSAAKAGIDNFTKWLAVYLAETGIRVNAIAPGFFLTNQNERLLLDQNGEFTDRAKKIISHTPMRRFGKPEDLLGTLLWLADEKMSGFVTGITVPVDGGFTAYAGV

SEQ ID NO: 5470 - protein, 337 aa, Bacillus licheniformis
MKQIVCEKPYRFKMTDVKMPELKDGEALVRIKRIGICGTDFHAYCGRQPFFSYPRVLGHELSGEIVSIDNSGGTLKPGDQVSIIPYLECGACIACRNGRPNCCVNLNVLGVHTDGGMREYINVPADHLLKTEGLTLSEAAVVECLSIGAHAAERANIKKGETVLVVGAGPIGLSVMKFAKLKGAKVIAMDVRKERLTFSRRWAEADEVVLGGEHAADEIKRLTNGDFPTAVFDATGHPASMNSAYQYAAHGGRLIYVGLVNDHLAMPDPEIHMRELTILSSRNALRRDFETVMKAIMDGGADANRFVNGQMAFHDVVDGFQSALAPETNPVKVLIHL

SEQ ID NO: 5471 - protein, 423 aa, Bacillus licheniformis
MFSNGRGFVIVMLFLAGVINYLDRSALSVAAPFIQEDLNIRPAQMGMLFSSFFIGYAVFNFIGGWASDKYGAKHTLSAAMVVWSVFSGAIALTYNFVSLFIIRVIFGMGEGPLSAATSKSVNNWFPQKERARALGMTMCGTPLGGAVSGPIVGLIAIHWGWKASFVLIMIIGLVWTCFWMKFMKDKPADSGSLSPEKEARPKKDTGIPLSFYLKQPTVLFTAFAFFSYNYILFFFLTWFPSYLTTARGLSIHDMSVATIIPWVVGFLGLALGGFISDYLFKLTGKQMFSRKAVLVCCLLAAAVCIGFAGLVTTAFGAVALVALSVFFLYLTGITYWAIIQDIVHPDRVGGVSGFMHFLANTSGIIGPTVTGYIVEYTGAFTSAFLLAGGLAVAGSICVALFVKPIRSERLPQSVGEGGQGHPL

SEQ ID NO: 5472 - protein, 57 aa, Bacillus licheniformis
MEPAFQQDQESVKKRLAFKMFKRQSKTNIAKYEVSPYTERIFRQNERLIGEYKRKKA

SEQ ID NO: 5473 - protein, 248 aa, Bacillus licheniformis
MLLFYQFLVWLIVLALALYVAAVWRFEKQLAEKTVAIRKTWYLLYVIGAVIYWTHDPQSIFTNPLHYLIVAVFFTLTDAFIFLNAYFKKLGSSELATDTRMLLEENNDLLHTYQNRLKTFQYLLKNEPIHIYYGNIEAYAEGIEKLIKRFAEKMNISAALCEYNSEESKDHLLEHMENRFDVQEKLDRKDVYYEENGKMVLIPFSIHDFDYVMKLTSEDLVTEFDYLLFTSLTSIYDLLLPNEEEGDD

SEQ ID NO: 5474 - protein, 332 aa, Bacillus licheniformis
MDLLFVLTILIVIFALAFDFINGFHDTANAIATSVSTKALKPRHAIIMAAVMNFAGAMTFTGVAKTITSDIADPFKLENGSVVILAALIAGITWNLVTWYFGIPSSSSHAIIGAIAGAVIASEGFAAIKYHGFIKIIEALILSPILAFVLGYLIYSIVKVIFKNSNLAKTNKRFRRVQIATAAIQSYTHGTNDAQKAMGIITMALIAGNLHSTTDIPFWVQFACAMAMGLGTSVGGWKIIKTVGGKIMKIRPVNGVSADLTGALIIFGATIVHLPVSTTHVISSSILGVGASHRVKGVNWGTAKRMLITWVITLPISATIGAFAYFILDLFF

SEQ ID NO: 5475 - protein, 205 aa, Bacillus licheniformis
MLKRKKDKFSVLLTEIAKNLDETAEYFVNYKVTNQTTLKEFADTLKEYETKGDNYVHTMIKELNKAFITPIEREDILQLTNSLDDVLDGIEHFSAMMEIFSITSSDEHIDKFSGYIRECAKEILVTIELLAENRLKEIQPHAIKIKEYEHNCDNLHRKSLKNLFGKETDPIKVIQYREIYETLEEIADSCQSVANNLETIIMKNA

SEQ ID NO: 5476 - protein, 557 aa, Bacillus licheniformis
MSGGDGDKVAVGKDGMVATAHPLASKIGAEVLKKGGNAIDAAIAIQYALNVTEPMMSGIGGGGFMMVYDGETKETSIINSRERAPEGAKPDMFLDEDGKVIPFSERSRHGNAVGVPGTLKGLEAAHKKWGTKKMEDLISPSIKLAEEGFPIDSVLADAIKDHQDKLSKTAAKDIFLPDGEPLKEGDILVQKDLAKTFKLIRKEGSKAFYDGEIGRAIADVVQDFGGSMTPDDLSRYEVTTDKPIWGEYHGYDIASMPPPSSGGVFMLQMLKLIDDFHLSQYDPKSFEKYHLLAETMHLSYADRAAYAGDPEFVDVPLRGLLDPDYIKERQKLISLDSMNRDVKEGDPWKYEEGEPNYEIVPQPEDKTIGETTHFTVTDQWGNVVSYTTTIEQLFGTGILVPGYGLFLNNELTDFDAIPGGANEVQPNKRPLSSMTPTIVFKDEKPVLTVGSPGGTTIIASVFQTILNYFEYGMSLQDAIEEPRIYTNSLTSYRYESGMPEDVRRKLNDFGHKFGSNPVDIGNVQSIFIDRENKTFMGVADSSRNGTAVGVNIKTSAK

SEQ ID NO: 5477 - protein, 214 aa, Bacillus licheniformis
MIHTLANGFYRFCEWVMRLAYLNLLWIGFTLAGAVIFGLAPATAAMFAVTRQWTLGKTDVPVFQTFFRAFKKKWAKSSVLGLILGLVGLLLFVDFQIAAVYFHDQPVFLSLFISLFIIYAIILLYAFPIDVHYDLKRIAVLKYSFIIGFSRPLTSFFMLISAFGMILLALFHVTFLLFFSGSALSFILTKLSFQAFRAIDGRRTDKQAAAPRLK

SEQ ID NO: 5478 - protein, 578 aa, Bacillus licheniformis
MNRYQHLKIKDQLFILISLIMAVSLILILSGIQYAFRVYDQQIYRKSSQVLMLSSKSIEDELKKIEDVSYQITTDADIQANLLKAGRGQNKYGRYRIKSKIWDKLAEYTGSKRYIKSIHLFDASGTEYSAGANLTEALREQKNALIEKASRQKGSNMWEPMPGETGELLSVREIRSYERLNLDHLGTVVIVADLKRVIGDLPKDWGEGAGKIAMSDGRELFFSEMPFSQTDGLRLSSHAENGYDIVEENGQRFFVSYVKSAYKNWTYWSLIPFDAMFSKISAMKTILISLFILFFLIAVLFGRKMARGITSPIEKLVAAMKNVQNGDFKLAPLTRAPLDRQDEVSVLNRNFFTMVERINELIAENYKKQLMLKETEFKALQAQINPHFLYNTLESINWLAKTNRQPQISKMTESLGFLLRNAINMKTDVLTIEEEAEIVRHYFTIQRFRFEERLVFELDIEPAVKKCRVPKLVLQPLAENAITYCLEPFIEPCHIQIKAYKKEELVYLTVADNGPGMDEDFLEKARKELVRTTGRGIGLQNIDERIQLMFGKGYGLTISSEKNKGTVMMIKIPFQSGV

SEQ ID NO: 5479 - protein, 388 aa, Bacillus licheniformis
MYKVLLADDERIILDGISSMIEWNSFGTSLIGAAQNGIDAYRLIMEKRPDIVISDIKMPGMGGLELIEKVSRDHPSIRFILLTGFGQFEYAKKAMSYGVRHYLLKPCNESHITDSLQSVIGELKKEESAQKVKTDLEMMKPHLMKQMLKELITGGGIEDEACLRFFSEQKAIRLILFSVRDGEDKDYAQGVESIADEVLNGAVIASARVQQLLVCAVDGTLASAVLEEKMKSVQELSRRLLRFEPEASLSESGNISEASAMYEKAYRKIVQDEGETSVLIGRMLDLIEKEASNPKLSLKWAARNMLYMNPDYLGKLFKQETGEKFSSYVAKVRIEKAIAKMKKSKNTAIGTLAEELGFGHNPKYFSLVFKKYTGLTPSEFRKKEDNTF

SEQ ID NO: 5480 - protein, 431 aa, Bacillus licheniformis
MRRFVFVSLCILLTLGLFGCSSNTEEAAGADGKKKVTLRVAWWGGQPRHDYTSKIIELYEKEHPHVKIEAEFANWDDYWKKLAPMSAAGQLPDVIQMDMAYLSQYGKKGQLEDLTPYVKDGTINTESIDEKTIKGGKIGDQLYGFPLGVNVLSVITNDDLLKEAGVEIDDGSWTWTDFENLALEVEEKTGQYGSNGMHPPDVFFPYYLRTKGERFYKEDGTGLAYSDDKLFVDYFKRQVKLVDEKASPTPDESAQVKGMEDDFIVKGRTAATWNYSNQFAAFAQLTDAPLSLKLPPEQAKEKALFLRPSMLFSIPKSSEQKKEAAAFIDFFINNEKANALIKGERGVPVSSKIAETVKSELSEEEKKIFEYVERATEYAGEAEPPEPISSAEVIKLLKDTSDQILFKKITPEEGAAKFRKEADAILKRNQQ

SEQ ID NO: 5481 - protein, 299 aa, Bacillus licheniformis
MKRKKRIDNLAGYAFISPFIIGFLCFTVIPMGASLFLSFTSYDLFTPPKWVGFDNYKAMLTDDEKYWGSLKVTFYYVLAGVPLRLAFALFIAVILNRAEKGVGIYRTLFYLPSIIGGSVAVAIMWRNVFGNDGVINGLLFFLGFDKKIFWYQDPTSALWTLILLSVWQFGSSMLIFLAGLKNIPPMYQEAASVDGANRFQRFFLITLPLLSPIIFFNLVMQTISAFMTFTPAYIISKGEGGPLDGTLLYSLYLFQRAFNFFQMGYASAMAWVMLILIGLVTFILFKTSSLWVHYESKEG

SEQ ID NO: 5482 - protein, 297 aa, Bacillus licheniformis
MEPVKDISGRAAPAPLPAGNRKKRAGRLVFHITTAGLAIILLYPVIWLIASSFKESASIFATSHSLIPDPLILSNYTEGWKGIAGQPFITFIKNSLIIVGLSTAGAVLSSAFIAYGFARIPFKGKAFWFSCMMVTMMLPHEVLMIPQYIIFAKLDWLNSFKPIVVPQFFGHAFFIFLMIQFIRTIPVELDEAAKIDGCSRLGIFFRIILPLIAPALATSAIFSFYWKWEELINPLLYLNKPELYPVSLALKLFLDTETASNWGAMFAMSVVSLVPVILVFFVFQKSIVQGISMSGLK

SEQ ID NO: 5483 - protein, 344 aa, Bacillus licheniformis
MTKLVFDEEKLNQVIDRIVKRTFEMDFEWDWPGGVAFYGVAEAYEATENEEYLELLKNWTDEKLEDGLPKLSINGVSIGHTLISLYQATGDDRYLDAARQMADYVLHEAPRFADGVLQHTVNSEKHVFPEQAWVDTMMMAGLFLLRIGKLVGSEEYFEDGLSQYHGHEEFLQDMETNLYYHAWDHVAKNNLSGIFWGRGNGWAALTMAKALPLIDVTHPSYMIIDGSLRDLLSALVRLQHPSGLWHTVLTDPDSYLEVSGSAGIASGLLSRGSLYHKSVQKALSAITDAVAPDGRVERVSAGTAVMRDAQGYKDVPYKRIQGWGQGLALTFLADVVRSKSRAFQ

SEQ ID NO: 5484 - protein, 760 aa, Bacillus licheniformis
MKKLHQRYVSRRKGSFFKKSFVMILLIACIPGLLTGAGVYLFSAAKIEKELQHLHENQVKRQISQIDDKLEGLEIMLSQLAYDPRLMNGLADADLQTDFQTTYKLSKSLFLLQDQNPLIHKVELFIQGKEPILLNPEYNGLTDRKILKAYHSLLEGGQNVYWKDMSGASSGMALVHKIPGGILEPFGALILTLDERELGRLLESLSPYSKGTALLFHHNQKPVSWSNRGKTNFESALKERLEKQKNPQGSFVMDWSGGAYSVSYGRMDRLNQEWTYVSASPMSAITAPVLFLSKLIASVSIAGIVLAFILAWYASHKIYSPVARLIKLCSGEGKAAYFPDEFHWLEKRWEDLSEESGRLKKELPHAANVFFQRLLSGYFADESERNLRDRLKRWGWEAKDNVFTIIDVQLTGLYEGNGSFTKKDESLAGFLLGNITRELAGRTFNHIYMTDVRSLSLAVLLASGRNTAFKEEIAQFVRELTDVIYSISKLHVTVTVSKTADKLKDIPGIYEEVKEGRHYRQFENASQVIDLSRREDMPPAESYYPFALEKEVVRALRLEERDEVERRIRLFIRELSEKGKTEIRIQPGMMQLFAKIQEEIFHSGLHPYELFSRKNLLQELSELREPERAVGWMMERCISPYLKEMEGRKNRQQKRLVEQVLEMIHQDYMNDISLESCADRAGTNSYTLSKAFKQVTGINFIDYVTRLRIEKAKELLLETNKKIHDVSEEVGYRHSYFNRIFKKQVGIPPSRYRQIHQESS

SEQ ID NO: 5485 - protein, 238 aa, Bacillus licheniformis
MKRTDKKPKVTVYLAGDSTVADCPPHEAPMAGWGQMLPLFFSDEAAVVNMAKGGASSNSFIDEGRLDDITERLAPGDYVLIQFGHNDQKPYGTDPYTTYQEHLVRYVEAVREKQATPVLITSAERRRFDQNGKPADTLGDFPKAMKALADSFDVPLIDLWSKTKALYESLGIEGSKRLFVHFQPHEHPHYPNGIEDNTHFSEAGARQVARLVTEGIRELGLPLSAYLLCERSDFRAGV

SEQ ID NO: 5486 - protein, 230 aa, Bacillus licheniformis
MPECNGREGSLIYQNPLSSPEDLRGWVMEGKGIVRFQNGRLHMENELDAEQYGDDAHFVYWCPETFPDGIVVKWDFYPVREPGLCMIFFAAAGMNGEDLFDGRLAERTGKYPQYHSGDINTLHLSYFRHKHADERAFRTCNLRKSRGFHLVCEGADPLPPAADALPPYRMKLIKDGAYVRFSINELPILEWTDDGRRFGPVYGAGKIGFRQMAPLEAAYANFEVRRLLRG

SEQ ID NO: 5487 - protein, 203 aa, Bacillus licheniformis
MRDKGVMAMMYGACEAIMKIAWLNGIWVLFTLGGGIVFGWAPSTAAMFTVVRKWLLGRTDAPLFKTFYQTYKKEFFKANGLGLILITAGTILFVNYQFFRVRADLFSIMISYATLVAGLIYLVVFIYIFPLYVHVQLPFVRYFSQAALIGLVRPLTTAGMAAAGCLVVYVLLTVPGLIPFYGVSLFALVSMFIAHRCFLRLEG

SEQ ID NO: 5488 - protein, 622 aa, Bacillus licheniformis
MKKGKKRWKNLLAASSLLLITLVTGFSEQAEADGRTAAQARQMESLNRGLVAVKTGNGVFVSWRLLGTEPSSVSFNVYRNGKKLNGSPITSSTNYQDAGGDLNAVYQVRAVLNGREQAPSESVGVLNKQYKSVPLQKPAGGKTPDGVSYTYSANDASVGDLDGDGQYEIILKWDPSNSKDNSQDGYTGDVLIDAYKLDGTMMWRINLGKNIRAGAHYTQFLVYDFDGDGKAEIAMKTADGTKDGKGKVIGNANADYRNAQGRILSGPEYLTVFKGDTGAELTTVNYEPARGNVADWGDSYGNRVDRFLAGVAYLDGERPSFVMARGYYTRTVLVAYNFRGGKLTKLWTFDSDAPGNGAYAGQGNHSLSVADVDGDGKDEIIYGAMAVDHDGKGLYSTGWGHGDAMHTGNLDPSRPGLEVFQVHENSNSPYGLSFRDAKTGKIIWGVHAGKDVGRGMAADIDPRYEGAEVWANGSLYTAKGVKIGNTLPSSTNFGIWWDGDLQRELLDSNRIDKWDYQNSRTVNLLTASGASANNGTKATPSLQADILGDWREEVVWRAEDSSELRIYTTTDVTEHRMYTLMHDAVYRLGIAWQNVGYNQPPHTGFYLGEGMQTPEKPNIYTR

SEQ ID NO: 5489 - protein, 102 aa, Bacillus licheniformis
MNESSVYQNGAGYGFSQAGSAVCKKTQKKEALKKDYCIVNRTAFLADLSPGKYRVTVFASSSGELKLYAEGEKMGTIPAGAKGSSAEKAFTVSVEDGRLDLE

SEQ ID NO: 5490 - protein, 372 aa, Bacillus licheniformis
MYQFDFGDGPLASGFIPVGAASAYTPLKGYGFDDAAKVSCTDRGTADPLRSDFCIPDGTAFTVDLPDGQYQVQIITGDARAKTNMDVRANGMLQLYSFGAEAGGYNEKTFPIHISGGRLSIQALTARTMPRLNALVITKTAYHVTDDNTTVFLAGDSTVSDYEPGYAPMAGWGQFLGGYFSDEIVIDNQAKRARSAKSFVDERSLATILNRMKRGDYLLIQFGINDAGQDPARHTDPYTTFQEYLRTYINKAREKGGRHVLVTSQSKRTYDEKGVFYNSIGEYPNAMRQLGREMNVPVIDLNKKSIEYYNEIGVEATKNVFMFLEPGESPNYPEGIQDRVHFHEFGANQLARLVTGEISDLNIYPLKHSLKK

SEQ ID NO: 5491 - protein, 628 aa, Bacillus licheniformis
MGEKDRHAAADRVRPVKTAAKPKQMEHLNRGLVAVKTKKGVFLSWRLLGTDPEETAFNLYRNGQRINSTPISSSTNFLDKHGNGKSLYYVSKVLGDKEVETSPKTAVWQKPYLEVPLNKPDGGTTPDGAPYTYSANDASIGDLDGDGEYEIVLKWDPSNSKDNAHNGYTGEVIIDAYKLDGTFMWRVHLGKNIRAGAHYTQLMVYDLDGDGKAEIAMKTADGTVDGTGRVIGDQAADYRNEGGRILAGPEYLSIFHGETGRELATVDYDPPRGRLEDWGDGYGNRMDRFLAGIAYLDGERPSLVMARGYYTRTVLVAYNFRDGKLTKLWTFDSDKPGNEGYAGQGNHSLSVADVDGDGKDEIIYGAMAVDHDGTGLYTTGLGHGDAMHVSDLDPDRPGLEVFQVHEDPRLPYGLSFRDAGTGEILWGVPADTDVGRGIAAHIDPRYKGALVWAIDPPGNEGKSYGLYTSKGEKLSDAAPASANFAIWWDGDLLRELLDHDWKEPAGIPKIDKWDYHSGRLVNLLTADGTLSNNWTKGTPVLQANLFGDWREDVVFRTVRSDALRIYTTTEPTEHRFYTFMHDPVYRLGVAWQNVAYNQPPHPGFYVGTGMDKPPRPNIYTVPCKRNEE

SEQ ID NO: 5492 - protein, 330 aa, Bacillus licheniformis
MGYQASDVRYENMKYNLCGHSGLKLPALSLGLWHNFGEAASLQNAKALLRKAFDLGITHFDLANNYGPPPGSAEETFGKALKTDFAGYRDEMVISTKAGYTMWPGPYGDWGSKKYLVASLDQSLKRMGIDYVDIFYSHRPDPHTPLEETMGALAHIVRQGKALYVGLSNYSAEQTEKAADILQEYGIPLLIHQPKYSMFHREPEKGLLQVLQKKGAGAIAFTPLAQGLLTTKYLTGIPAGSRAADANSPFLQAEGITEDVLGKVRKLNQVAAERGQSLPQMAIAWLLKDPRVTSVLIGASKTEQIEENAAALKSARFSAEELDTIDKILS

SEQ ID NO: 5493 - protein, 214 aa, Bacillus licheniformis
MTISIYLAGDSTVQHYKADSPQGGWGEFLQSYLSGNVQVINRAIGGRSSKTFVEEGRLASILDVIKQDDWLFVQMGHNDASKDKPERYTEPYTTYKQYLKMYVDGARQKGASPLLITPVARLHYKDGVFLNDFPDYCIAMKQVASEENVRLIDLMDKSLQHFAEKGYSEVFKYFMISENVNDYTHFTKKGAREMAKLVSEGIRELGLPFVKETV

SEQ ID NO: 5494 - protein, 663 aa, Bacillus licheniformis
MNGKLYHGACFYPELWDEDVLDEDIRMMERIGINVVRIGEFAWSRMEPEKGRIDVGFFADVIRKLRDNKIETVMCTPTATPPIWLTHGHPERMHVNEKGETMGHGSRQHACTNHPYFRERARLIIKHIAKEIGELPGLIGWQLDNEFKCHVAECICETCRTLWHKWLEDRYQTIDRLNEAWGTGVWSETYQCFEQVPQPGPTPFLHNSSLRTMYQLFSMDKISEFAREQAEVIRAYSDAPITHNSSVMFGVDHEDLFKSLDFASFDTYASQENSQAFLFNCDLWRNIKKGRPFWIMETSPSYSASLESYAAPHQNGYLKAEAVSSYALGGAAFCYWLWRQQRAGSEQPHGSVLSAWGEPDVGYENVLEAERARREVEHIMLATAPLQAETAVVYSDRAKVFLKTEPHRGLHYRTLITEFYDRLLKMGIHRDVILEGSPLDGYKLLFTPFIHYLPPAFIKKAEAFAQSGGIWIAGPLTGGRTEHHTIHTDCGLGPLEKCSGVKTLFTFPMDERNSSGTAFGVKAPLSLWSAVFEAGGTKAVGMIEKGPASGKAFITEHKCGKGKIVMLGSMPAGEAGDIMMKKLISHYAEEAGVEQKTDVTPGTVVAPRKGADGLVWVVINMDGKGGAVTLDGNGTDLLSGRPVTGRVTLGPHDYRVILLSENK

SEQ ID NO: 5495 - protein, 863 aa, Bacillus licheniformis
MKAQAELKWLNRAPASFGGVTWGVPWAKGVLQKGETAVIASENAPYLQTWPLAYWPDGSIKWTGHAAVFPEESGRRFTLQKGKPGAPKTVVRVSEQKDEITVNTGAIVCKLGKSGPALIRSISISGEMMAKEGRLIALKEKRSGSDTQSMYYIERFESLVKRAAIEQNGPVKTVIKIEGVHRGGGIDVWLPFTVRLSFYAGVPSIRIVHTIFIDCNAETEWIKGLGLEMSAVLSGAPRNRHIRYAADGGIYGEASQLLVTRRFNETNGFYERQIAGQPVPEESEVVRDAEKNAVWNDFKLIQDSPVHWRLKKRTGKDCAWVDAIHGGRAKGLMYAGGENGGIALGLRNFFEKYPSSLEAQGLAGGETKLTAWFWPPEAEAMDFRHYSKGTHVESAYEGFAEMRSTAVGIANTSEVNLACFSNPPSNEELNRAADEWQNPPLLICEPDYYYDTRALGVWSLKDKRRPLSAALEDQLDEALKFYMNEVEQRGWYGYWHYGDVMHTYDAVRHVWRYDLGGYAWQNTELVPNLWLWQSFFRSGREDIFRMAEAMTRHTSEIDCYHFGDYKGLGSRHNVLHWGCGCKEARISMAGLHKPYYFLTADERTGEVLTEVKDADRALEMLDPMRAYYPEKEFPAHARVGPDWAAFCSNWLTEWERTGDEAYLDKINRGIGRLKALPLRLLSGPTFGYDPKASDLLHMGDGNHGGYHMVIAFGAPQTWMELAELLEDNEWKEMLGEFGEFYLLADEEKRKRSGGKLHDDLFHWPMFSAAMAAYAARLHQDRKLAEKAWRLLLDEKQSHTPLPIAPKQVHAWNTITEIPWVTTNCVSQWCLNTIAVLELLKDMPPDQDMQEKIIKAMKDHPARV

SEQ ID NO: 5496 - protein, 507 aa, Bacillus licheniformis
MARLKLKGNKWLAAPAVFLLLIGCSANETSNQDGKGKEKDAIHIMAPLLSPESPGENSPSLKALEKYTKKQIKVTWVPNSSYNDKFNIVMASGDLPQAIVVTDKSPGFIKSVKSGAFWELSPYLKDYPNLGKADEKVMKNSSINGEIYGIYRARDLIRASIIIRTDWLENVGLEMPKTIDEFYDVLKAFKEKDPDGNGKDDTYGMVVPKWMGLGNGSPWDIMQTWFGAPNRYGVDEKGELIPDFTTEEYMEALRFFKKLYDEGLINKDFAVMDSAKWNDPVVKGKAGVIVDTGSRASQIQSAMEEADPGNKDVIDVIGTVKGPKGTYTFPTSGYAGMIAIPKASVKTEKELKEVLGFLDKMNDEEAQIIANNGVKGRNYKLENGAYTSLEKNNKKLLYEHEGLAQFSMGIPEQRYYVEKQESKLFKHREQIRKEGEKIAVFNPAESLVSDVYTQKGAQLDNIILDAKTQFIIGDIDEKGFQDAVELWYKSGGEDLMKELNKRYKETK

SEQ ID NO: 5497 - protein, 317 aa, Bacillus licheniformis
MEITAKTGKPAVKTEKKPTGLEAVKRDKWLYLLLVPGVLYFLIFKYWPMWGVLIAFKDYSPYLGFWQSEWVGFEYFKDFFMNPDFFRLLRNTLMLAALDLIFAFPAPLIVALLLNELRHAIYKRCIQTFIYVPHFVSWTIVVSITFVFFTVDTGVMNKVLQSITGREIAFLSDPEWFRPMIVLQSIWKETGWGTILFLAALASVDQEQYEAAVMDGAGRLRRMWHITLPAIRSTIVVLLILRIGSFLNIGFEQIFLMTNSLNRSVAEIFDTYVYVVGITQGAYSYSTAVGLFKSVVGIILIFCANYIAKKFDQDGLF

SEQ ID NO: 5498 - protein, 294 aa, Bacillus licheniformis
MSGAETIHNTKAGRVFDWFNVIFLGCCGLITVLPFLYIIAGSFATEAELAERSFFIFPETFSLDAYRYIFSTPTFIRSMGVSVLITVVGTIVQLFFTFTMAYPLAKRHIKGRNLLLNLVIFAMLFSGGMIPTYIVVKSLGLLDSYWALILPMAINPFNLIIIKNFFQQLPKELEESAKIDGCSEIGVFLRIALPLSKPIIATFALFYAVGIWNDFFHALLYINDSAKWPLQMVLRQVTILSDLTGTTNDMMETVPPEQSIKLAVIVIATLPILAVYPFLQKHFAKGILIGSVKG

SEQ ID NO: 5499 - protein, 442 aa, Bacillus licheniformis
MNAEANGLKKEIGLLFALSLVIGTIIGSGVFMKPGSVLSYSGNAQIALFAWLLGGILTLAGGLTIAELGAQIPKTGGLYTYLEEIYGEFWGFLCGWVQIIIYGPAIIGALGLYFGSLVANLFSWDKSWTALIGIITVAFLCIVNIVGTKYGGAVQTITTIGKLIPIVCIIVFGLWQGDEYIFSSVTESIASQNFGAAVLATLFAYDGWILLAALGGEMKNPEKVLPKAMTGGILIVTACYLFINLALLHILPADQIVKLGENATSTAATMLFGPLGGKLISIGIIVSIFGCLNGKVLSFPRVIFAMAEKKQLPFSRWISHVHPAFHTPWIAVIVQMIIAVILMIISNPEKLSEVSIFMIYIFYVMAFFAVFILRRRKNGQGRSYSVPLYPYLPVAAILGSLFVLVSTLITDFYSCLWSILIGLVGLPVYFWMKKRNKNGSAA

SEQ ID NO: 5500 - protein, 317 aa, Bacillus licheniformis
MNVNGIHHVSALTANAQHNLDFYVKGLGMKLIKKSVNQDDPTMYHLFYGDEVASPGSDLTFFEIPMLARRREGTNCISAVSLRVPGEQALEFWEKRLHELGTEICGIETRAGRSILRFLDHEGQNMMFVADEKGKDHGVPVKNGVIPEDAAIRGLGPVELTVRDAGPTAAVLTDILGFHKIGEEQADESGQTLHIFESGEGGAGTEVHVKQSDDGRRERPGRGSVHHVAFRVKDEEELKQWHEIISENGFSNSGIVERYYFKALYFREPNGILFELSTDGPGFAVDESIDELGQSLALPPYLEHRRKEIEARLKPIR

SEQ ID NO: 5501 - protein, 120 aa, Bacillus licheniformis
MNTVSQEIQDLSIKSLESTFNKLTNAYKSTTEKGSNTTLVKKRLNAVKIGLESLKGTWYGEDFGYNEEIILTTKKVLKGIIPSIEKQIAKAKEGSPQKTLNERRLTALKLAIESLENRLI

SEQ ID NO: 5502 - protein, 433 aa, Bacillus licheniformis
MMEYNREDQLETKNELIVSDQKPDQAIKKAEQQKRRLSWMTPILSGIIGGSLVLGVTTYQHSKDETANTSVQTQTNETSNSSASSTKANTEKLSSTNSSDISTMVENVSPAIVGISNYQKQTESGMFGFESNSSSSSEQETGTGSGVIYKKANGKAYIITNNHVVEGASKLTVSLSNGKEVEGKLLGSDSLTDLAVVEISADHVEKVASFGDSSSLKAGESVIAIGNPLGKDLSRTVTQGIISGVDRTVSVDTSAGQTEMNVIQTDAAINPGNSGGALLNTKGEVIGINSMKISESGVEGIGFAIPSNDVKPIAEELMSKGKIERPFIGIGMMDLEQVPENYQTGTLGLSGSQLNKGVYIRQVASGSPAEKAGLKENDVIVSFNGKETDTGSALRNLLYNDAKIGDTVKVTLIRNGKTMTKQITLDQKESASS

SEQ ID NO: 5503 - protein, 270 aa, Bacillus licheniformis
MNKIGFIGYGSMAQMIAVKLLDQGKIRDDMVVVSSRNDGKTEELKKLYPNVACQSADELAKQCGLIFICVPPMAVKETLEKIQPFLQEDVHIVSIAAGVELDRLHDWTSGQVTRYIPTLTSEAGIGVSLVVHGERVAEADKSRLEEYLSAFSTVKQINERDIDAASNLTSSSPGFIASIFEEFAQAAVRNSSLTKEEAFQFLIHSLLGTGKLLMEKDMTFAQTLDRVATKGGITAEGAEVIQDAMPEVFDELFARTMKKYEVIKDAVRRQ

SEQ ID NO: 5504 - protein, 274 aa, Bacillus licheniformis
MKLYMSVDMEGISGLPDDTFVDSSKPNYERGRKIMTDEANHVIDEAFKNGCREVIVNDSHSKMNNLLIERLHPEARLISGDVKPFSMVQGLDDTYDGAVFVGYHARASMRGVMSHSMIFGVRHFYINDQAVGELGFNAYVAGYYGVPVIMAAGDSEAAAEAEELIPNVTTAAVKETVSRSAVKCLTPEKAGRLLRERMAYAIQNRGQVKPLTPPDRPVLRIEFANYGQAEWASLMPGAEIEPQTTTVRYQAKDILEAYQAMLVMTELAMRTTFS

SEQ ID NO: 5505 - protein, 308 aa, Bacillus licheniformis
MAGYIMKRLLWMLATILVITTLTFVMMKVIPGSPFNEERNTNEAVQRNLEAYYQLDEPLFVQYLYYVKSIVTFDFGPSIKQPSQSVNDLLSRGFPVSFELGMTALIVAVISGIALGIFAALRQNGIIDYIAMTIAVLGISVPNFIMATLLIQQFAVNWNIFPPSTWTSPLHMVLPTAALAMGPLAIIARLTRSSMIEVLTQDYIRTARAKGLSPFKIVMKHALKNALMPVVTILGTLTAAILTGSFVIEKIFAIPGMGKYFVESINSRDYPVIMGTTVFYSIILIIMLFLVDMAYGILDPRIKLHKKG

SEQ ID NO: 5506 - protein, 319 aa, Bacillus licheniformis
MSLPVRTEKEASSGSDIPVEWFAPLKQKQDERESVARPSLSYWQNAWRILRKNKLAMAGLGVLIFLFFMAALGPVLSPHSVTQQTLSEQNLPPSTEHWFGTDELGRDVFTRTWYGARISLFVGVMAALIDFAIGVIYGGIAGYKGGKTDHAMMRVIEVLHGLPYLLVVILLMVMMGPGLGTILVALTVTGWVGMARIVRGQVLKVKHDEHVLASKTFGAKTVRIIRRNLLPNMMGAIIVQMTLTVPSAIFAEAFLSFLGLGIQAPFASWGVMANDGLPVILSGHWWRLFFPAFFISLTMFAFNVVGDGLQDALDPKLRR

SEQ ID NO: 5507 - protein, 332 aa, Bacillus licheniformis
MRKKVLEVENLHVSFTTYGGTVKAVRGVSFELYEGETFAIVGESGCGKSVTSQSIMRLLPKFSATVTDGAIRFKGKDLRHLSEKEMRKIRGAEISMIFQDPMTALNPTLTVGDQLAEALLEHRPVSKTDARKAVISMLELVGIPNPKERLRQYPHQFSGGMRQRIVIAMALICEPEILIADEPTTALDVTIQAQILELFKDIQRKTGVSIILITHDLGVVAQTADRIAVMYAGKIAETGARRDIFYRPQHPYTKGLLHSVPRLDLEDADLVPIDGTPPDLFSPPEGCPFTARCSRAMEVCGKIHPAVTEVSAGHRVCCWLQDERAKRALLTT

SEQ ID NO: 5508 - protein, 541 aa, Bacillus licheniformis
MKRLTSVLASAFAVILLFGCTANEQAGQETKKKAKETAGEQVLRLNNENEPTSFDPPIGFNNVSWQALNNLMEGLTRLGADHEPEAASAEKWNISDDGKTYTFTIRDDAKWSNGDPLTAGDFEYAWKRLLDPKTGSSAAFLGYFIEGGEAFNSGKGSKDDVKVKAVDEKTLKVTLESPQQSFLSIVANPAFFPVPQKIAEDNPKWHEEAATFVGNGPFKLAEWKHDESFTMVKSDTYWDRDTVKLDKVTWAMVDDRNTDYQMFESNELDTAYVPAEMSEKLMGSDEVKVFDQAGLYFYRFNVNKEPFQNEKIRKAFAMAVDQQEIVDYVTKNGEKPARGFVSPGIKGPNGKDFREEGGDLLKYNADEAKQLLEKGMKEENYEKLPAVTLTYSTKPEHKKMAEAVQQKLKSTLGVDVKLANMEWNTFLEEQKALKFQFSQSSFLADYADPINFLESFQTGNAMNRTGWGNSEYDELIKAAKNEADEEKRTELLHQAEELLFEGMPIIPIHFYNQVHLEKENVKGIVRHPVGYIELKWAEKTS

SEQ ID NO: 5509 - protein, 307 aa, Bacillus licheniformis
MNIAPQRLMKGDTVGVIAPASPPVPEKLDRAVRFLKELGLEVKVGRSAAERHGYLAGSDEERLGDLHDMFEDRSVKAVICACGGYGTARIAGKIDYRLIKSRPKIFWGYSDITFLHTAIRQNTGLITFHGPMLSSDIGKDDVHPLTRRSFQQLFQKMTLSYTEELSPLETLVHGAAEGELVGGNLALLVTTLGTPYEIDTKGKLLFIEDVDEEPYRIDRMLNQLKMAGKLSDAAGILLCDFHNCIPKKRDKSLTLKEVFQDYIASEGKPALSGFKIGHCSPNIAVPVGVKAVLDAGKKRLTIEPGIS

SEQ ID NO: 5510 - protein, 365 aa, Bacillus licheniformis
MKIAEITTNRIAVPLKKPFKTALRTVRTAEAVIVKVTAENGMTGWGEAPPTAVITGETLDSIEGAVNTILAPALTGCNLRMAEAIFHDIDKLIVGNTSAKAAVETAVYDCLAQLCGLPLYQLLGGYRREIETDFTVSVNDPEEMGKDAARYVQEGFRTLKIKVGKNDMATDLERIREIRKQAGPAVRIRVDANQGWTAKQAVKAIRKMEDEGLSIELVEQPVHRLDLEGLKQVTDAVDTPIMADESVFTPRDAFHVLKTRSADLINIKLMKAGGIRQALKINAMAEACGVECMAGSMIETRLGITAAVHFAASQKNVTKFDFDAPLMLKEDIVEGGIRYHAGTITIPDAPGLGITKVCHEGGEDK

SEQ ID NO: 5511 - protein, 295 aa, Bacillus licheniformis
MSLYTTAVSVANVWTSPEAPRTIDRMMLSNPVHVRSWLDELSYEERLELCTANLVQTQVLFGEDVQLIKERGDWAFVIIPGQPSAKDKRGYPGWIPKDCLVEKSPAKSETSAVIQKPTAFLYDDKKTKVIELSFLTKLPVLSSGGVWFEVDTPLGRKWLKKEDADLETPVKGSGDDIVQTGQAFLNLPYLWGGMSGFGYDCSGFVFNMLKANGRSAPRDAGDQAKGGKEVSFSSPKRGDLLFFAYEEGRGRVHHVGIYCGNGEMLHSPKTGKSIEVISLKGTIYEKELCAIRRYF

SEQ ID NO: 5512 - protein, 337 aa, Bacillus licheniformis
MQTGALLKVSRLKMHFDAGRGKTVKAVDGISFDIKEGETFGLVGESGCGKSTSGRVLMRLYQPTEGEVTYRGKNIHHLSDDESFQYNRKIQMIFQDPYASLNPRLTVREIMTEPMEIHGLYGGKKARLEKADELLEAVGLHKSFANRYPHEFSGGQRQRIGIARALALEPEFIVADEPISALDVSVQAQVVNLLKKLQKEKGLTFLFIAHDLSMVKHISDRIGVMYLGHMVEITDSGRLYQEPLHPYTQALLSAIPIPDPDVEDKRRRIILKGELPSPIDPPSGCVFRTRCPAAMDICAAKKPMLKEADDGHFVACHLYDGDARKEEAGLKVTLQAR

SEQ ID NO: 5513 - protein, 295 aa, Bacillus licheniformis
MDSALSKKNRGAGCTSEYDVLKKVVLCRPEYMEIAEVINETQKYFQKDNIDKTLAVRQHNTLIKELESRGIEVVILPALSQFPEQVFTRDIGFTIGGTVFSAQLSADIRQGEENVLQEWLAKEQISWTAFNEGYQIEGGDILVDQNTIYAGISHRTTFSAVQELKRRLPSYEVIPVPFEETFLHLDCVFNILSPTEALVYPKALGEREYDVLKKRYEMIEITDDEQFQLGTNVLSIGNKTVISLPVNRHVNQELRKRGYTVIEIDLSEIIKSGGSFRCCTLPIERTSTECYKGGA

SEQ ID NO: 5514 - protein, 172 aa, Bacillus licheniformis
MNGPEKRYCKESKVVKTSRVFPLDTNNHNTLFGGKLMSYIDDIASISAARHSRCETVTASMDSVDFLEPIRQEDSVCLESYVTWVGRTSMEVFVKVIKEHLLTGERKLAATSFLTFVALDQDGNPQAVPQVVPQSEEEIMLHETARQRAEERKNHRKHSKALAQALAVDKPW

SEQ ID NO: 5515 - protein, 247 aa, Bacillus licheniformis
MGEMLEFVWTFLAKPALVFSIAYILFRIAGKKAVSQMTNFDLLLTFAIGTIISEPILTSKISMSIYYALTFLIFYLLIEKLSLHNKWRWFLVVSPTVLIRNGNIDKGGLKRERLTVNELLGKLREKGYADPKDIDLALIEESGQISVIPKSEARPVQPRDLNLETKRNFVPIPLILDGEIIEHNLKYLKKTKEWLFQKLEDKGIEQAMLPTITLGTLNEKNEIIIDTEDPGSPLTHDPYLYKPGQDH

SEQ ID NO: 5516 - protein, 435 aa, Bacillus licheniformis
MKRFFSVIILGALLLLGTSAPIEAADYGRDVLGSKDGWGAYGKGTTGGADASSDQVYTVKNRKQLVEALGGDNKKNSENDTPKIIYVKGTINLSVDDDNNPLGYEDYKDPEYSIEAYLKAYDPKKWGKKEPTGKLEEARLRSKDNQKERVLIRVGSNTTIIGLGDDAKIVGGGLYVKNAENVIIRNIEFENAYDFFPGWDPTDGSSGNWNSEYDNLLIEMSKNIWIDHCSFNDGDQPDELTETHFGREFQHHDGLLDIKKQSDFITVSYSIFSGHSKNTIIGSSDSYKADNGHLRVTFHHNLYENIKERAPRVRYGKVHIYNNYFKSTKDSYNYSWGVGYSSKIYAEDNYFDLPEGTKPQKLMKVFKGDALYEKDTIVNNQKSVAKIDVVSTYNKANNASIKKSAGWKPTLFEKIDDAEDVPAIVEAHAGAGKLK

SEQ ID NO: 5517 - protein, 110 aa, Bacillus licheniformis
MSSTQMLKGILEGCLLAVISEGEIYGYEMTKVLAGYGFSDISEGSIYPILLRMQKEKWVETELKRSASGPKRKYYRLTPLGEAELQSFIDRWKALSGNVNALLEKKLKEK

SEQ ID NO: 5518 - protein, 249 aa, Bacillus licheniformis
MLSKDMQNVLDEMRIYLMSSGKSDKEIEGIMNELTVHAWEGEKDGKTVRQIFGDSPKSYVQALSKELSSRPGEIAKLFFAILIGAISYFIFSDAVNDSLDYSVYTLAGYPLYILLAAAMLPLLGRITAFKGKNTAFMYTMVYAALTFFPILAIIFIDRQFGTPVFSFDGGSRWLIMALSFLVIVCLSFRLKAGALSILPLLLAGTHFLFQYMNWDSAGAMMAETYIPYIGLLLVMFIETKRARNTAQYE

SEQ ID NO: 5519 - protein, 166 aa, Bacillus licheniformis
MDMMWGYVLVFILAAIPWFEVIGVVPLAIIAGLKPVPSAIIALFGNLLTVLLLIFLIDKVKVWLERRRGERRAETDKFSKRKSRAKKIWLTYGIPGLSFVGPFFIGSHLTAFMCMGFGAKRRQTALWMTGSLAVWTTASAVAAYYGFSFLAPENEGLLKNIFKQEE

SEQ ID NO: 5520 - protein, 173 aa, Bacillus licheniformis
MPFLKDLSPDEEMAPTVGLLFSAVNENIERLKSIVSGISREELEYKGEHGDKNSIAQLIYHLINVDVRWVYRLKESEIPRELEEKYGPMTDENGRLPEVTGVPLTVLIEWHEEVLEMLKHTAKGFSEKDLLKKVPYEGGFSTIRWGIWHMSDHNRYHQAHIQACLKEFRMQNS

SEQ ID NO: 5521 - protein, 109 aa, Bacillus licheniformis
MRWGSVILAALFEIGWVMGLKHADSALEWICTAAAVVMSFYILVKAGEKLPVGTVYAVFTGLGTAGTVVCEIALFNEPANIAKLALIGVLLCGVIGLKLVTNEEKGEAS

SEQ ID NO: 5522 - protein, 44 aa, Bacillus licheniformis
MWTGIGTVGGALVGILFYGEPKDGKRIFFIALILGSAVGLKLIS

SEQ ID NO: 5523 - protein, 300 aa, Bacillus licheniformis
MNAYMKQQLSQYQEINNDKARLLVSCPDQPGIVAAVSSFLFENGANIIESNQYTTDPEGGRFFLRIEFEVQGIREKIEQMKAAFASVAESFQMTWSMNLASELKRVAIFVSKELHCLHELLWEWQSGNLMAEIAAVISNHEDARETVESLNIPFLYMKANKDIRQEVEKQQLKWLEEYRADVIVLARYMQILTPDFVSAHPNKIINIHHSFLPAFIGANPYKRAYERGVKLIGATSHYVTNELDEGPIIEQDIERVDHRDNVEALKNIGRTIERSVLARAVKWHLEDRIIVHGNKTIVFN

SEQ ID NO: 5524 - protein, 365 aa, Bacillus licheniformis
MKKQRIVIKIGSSSLTNSKGSIDEEKINDHVRAIAALKKEGHEVIFISSGAVAAGFLQLGYPARPVTLKGKQAAAAVGQSLLMQTYIEHFADHDIKPAQILLTRNDFAKRERYRNAYATVMELIERGLVPIINENDSVSVEELTFGDNDMLSALVSGLIHADKLIILTDINGLYDSNPAEHPDARRFDYIPEITDELLGCAASAGSKVGTGGMKSKLLAAKTALSLGVNVFIGAGEGDDKLIQILKGNGDGTYIGQSDLSSVNNHRQWIAFHSPVSGKITVDEGAELAITENGGSLLPAGVTAISGDFPKGAVVEVYGPNGLAGKGQTLYSAAELEEVKGKRSDEFHHEEGIEVIHRNDWVSIKE

SEQ ID NO: 5525 - protein, 415 aa, Bacillus licheniformis
MSEVIEKAKKAKVAKEELVHQPTERKNEALSFIAEAIRFKQDEILAENEKDIVRGKEKGFSPALLDRLALTPERLNDIADAVMLLTKLEDPVGETLETIRKDNGLFIENVRVPLGVVGMIYEARPNVTVDAATLCLKTGNAVILRGSSSAINSNKALVRVIREALERSALPEDAVQLIEDTSKETAKQLFTLNDGLDVLIPRGGKNLIDMVVRESTVPVLETGAGNCHIFIDESAQPDMAEQVVINAKTQRPSVCNAIETVLIHKGWAEEHTKALLQKLEEAGVEIRGDEAVCTMLPSAVPARETDWGTEFLAPVVSIKTVAGIDEAIRHIRQYGTRHSEAILTENQENARYFLTSVDAAAVYHNASTRFTDGFEFGYGAEIGISTQKLHARGPMGLKALTSSKYIIKGNGQIRI

SEQ ID NO: 5526 - protein, 140 aa, Bacillus licheniformis
MKPLFTSQATANGGRDGQVTSSDRVLELELAMPGTPKAKENENATNPEQLFAAGYAACFDSALQLTAQKARLRMETEVTANVSLLKDEADGGYKLSVTLQVKGTGVEQRELEKLVHQAHTVCPYSKAISGNVDVNLEVIS

SEQ ID NO: 5527 - protein, 150 aa, Bacillus licheniformis
MANEFEHMRLDRQLCFLLYASSREMTKLYKPLLDELNITYPQYLALLLLWEHGELSVKTMGKLLYLDSGTLTPMLKRMEQHGLLTRERSPEDERSVIVRLTAGGQALQEKASSIPQHMIAQTDLSAGELKNLKQTLESLLASLTKKTDVL

SEQ ID NO: 5528 - protein, 137 aa, Bacillus licheniformis
MTALFTAKVTAKGGRSGHVKSDDGVLDHNIVMPNEKKEGESGTNPEQLFAAGYAACFGGALEHVAKQKGIDIDSEVEGHVSLLKDESDGGFKIGVKLIVTAGGVEKEKAKELVEAAHDFCPYSKATRGNIDVNLEVK

SEQ ID NO: 5529 - protein, 221 aa, Bacillus licheniformis
MAYLKKALVFSVLSLAIVLAGCGTGAAEKNNGNQSPADTAKQKAPDLKTYSLDKNIRSEEDFDLIGKYVHAEDDQITLEIKDKELIVPKSSRFHSEEDHDDLIGKLVKVEVDGKTQEAEEAELMPQSKADQNGVYEEEKDGSRKIIATFVSESEQNITIKTKAGEKTYQKTADFERDVAEAPEKLKGKIVRLEIEKDGKAESLDLESEDQKLEWYEPSASK

SEQ ID NO: 5530 - protein, 156 aa, Bacillus licheniformis
MNHEAFLQRAIDLAVESVKSGTGGPFGAVIVKDGQIIAEGKNNVTTSNDPTAHAEVTAIRLACEALGDYQLNDCILYTSCEPCPMCLGAIYWARPKEVYFAAQHSDAASAGFDDSFIYEEITKTKSERKIPFYKMDLQAKLEPFLTWEKTDQKVEY

SEQ ID NO: 5531 - protein, 210 aa, Bacillus licheniformis
MLTLYIARHGQTEWNIEKRMQGWEDSNLTALGLANANALGERLKDVQFQAAYSSPSGRAVDSARAMLQNRSIPFITDDRLKEISIGRWEGKTYDEIKQSDPDLLEAYFNTPETYMPDESESFYDFERRVSQAYQFILRRHREGNVLIVSHSVFILMLLNLIKKRPVGELWNSSYVHDTALAVVTVSEDGSAAIEREGDGEHRVEAKNATW

SEQ ID NO: 5532 - protein, 237 aa, Bacillus licheniformis
MTIRLNINDLHALARQFRYSHQRISDLIRLLNRHFHVLFSSVKTARTCGIDQAQSEMEHELKGFLHTLDDLQHLLHFTEIRMKKTDQMLAEKLFHSGGHLAGYLPIMSSLAAAKCSPGSYKLTAPPLSEPLALMKQIKQNGLSGLITKKRAAAYIQFDEEGQQQLWSARRMISRTIADNLCILAYQQIAKGPLSLTVLLFGKKAEADAADVKTVCLSKNKTITADTLHSFSAKIYSG

SEQ ID NO: 5533 - protein, 104 aa, Bacillus licheniformis
MIDDGIALERKIKRKIYQEDIHSLQLYVKDVNAAIDELRQESSSILKAHQTYINGWRGQAREMYDALLDDLDRAESRVYDKLRTIKEQADEEIERLQLKAEELI

SEQ ID NO: 5534 - protein, 762 aa, Bacillus licheniformis
MTNVKTSSLGFPRIGLNREWKKSLEAYWKGNTDRETFLKEMDEQFLAALQTQLDQQIDIIPVSDFTMYDHVLDTAVMFNWIPDRFKDINDPLDTYFAMARGTKDAVSSEMTKWFNTNYHYIVPEYEKGAQYRVTRNKPLQDYQRAKAALGTETKPVILGLYTFVALAKGYEQQDIKDIYNQMTPLYIQVLKELEQEGVKWVQIDEPALVTASPEEAAAVKEIYQTITEEVSELNILLQTYFDSVDAYEELISFPVAGIGLDFVHDKGKNFEHLKAHGFPKDKVLAAGILDGRNIWKANLEERLDLTLELIQRAGVDEVWIQPSNSLLHVPVAKHPGEHLADDLLNGLSFAKEKLLELTLLKNGLVSGKAAIQAEIDEAHGHLQDLKQYGAATNSAFAEERGKLTEEDFKRPTAFEERLRIQNDSLGLPLLPTTTIGSFPQTADVRSARQKWRKKEWSDEQYEAFIQEETKKWIDIQEDLGLDVLVHGEFERTDMVEYFGEKLGGFAFTKYAWVQSYGSRCVRPPVIYGDVEFKEPMTVKETVYAQSLTSKKVKGMLTGPVTILNWSFARYDLPRKEIAFQIACALRKEVEALEKAGIQIIQVDEPALREGLPLKERDWDEYLKWAAEAFRLSTSSVEDTTQIHTHMCYSNFEDIVDAIEDLDADVITIEHSRSHGGFLDYLEQHPYLKGLGLGVYDIHSPRVPSSDEMLTIIEDALKVCPADRFWVNPDCGLKTRQPEETIAALKNMVEAAKQARGKLAQTV

SEQ ID NO: 5535 - protein, 317 aa, Bacillus licheniformis
MQMRLIPYVTDTKLMDVNELPEGIDAIKAPELWSQGFKGKDITVAVLDTGCDATHPDLADRIIGGRNFTDDDNGKEDQFHDYNGHGTHVAGTIAANDQNGGISGVAPEANLLIVKVLGGEDGSGDYEWIINGINYAVEQKADIISMSLGGPADVPELKEAVTNAVKSGVLVVCAAGNEGDGNDRTEEYSYPAAYNEVIAVGSVSLTRESSEFSNANKEIDLVAPGEEILSTLPDHQYGKLTGTSMATPHVSGALALIKSAEEEAFKRKLTEPELYAQLIRRTLPLDYSKALIGNGFLYLSAPEVLAEKAGEAKLLSL

SEQ ID NO: 5536 - protein, 51 aa, Bacillus licheniformis
MKEQEDEKRDELSIEQAEFVPHPKYEGEYALLLHENYHLLSKDDLEQESEK

SEQ ID NO: 5537 - protein, 451 aa, Bacillus licheniformis
MVKNMTYDELILRIIILLRDGKRKEFQSLLEELQPYDMAILFKEMPEKHRGRYLSFLTVEDITDLMGELDREEQLVVLNKVGKEKAIHVMNKMDNDDLAALFEEMDPELKDQLLSSMEAEESEAVRVLMNYPPETAGRIMTNRYVWIPQHYTVKEAVVKLKSFAEIAESINYLYVINEQKQLVGVISYRDLILAEPDEKVQELMFTRVISADALQDQEEVARLIERYDFLAIPVVEKNHELVGIVTVDDIIDIVIQEANEDYEKFAASGKAITFDTKSYVAAYRRLPWLILLLFIGLISGSIMSYFEDTLQQVVALAFFMPMIAGMTGNTGTQSLAVVIRGLSKEELNKKTIFRLIFRELRAGIIIGIVCAIVITGIAIVWQGNLLLGFVVGTSLFATLIIGTMAGTIVPIILHKCNVDPAIASGPLITTLNDILSLLIYFGIATAFIHSL

SEQ ID NO: 5538 - protein, 135 aa, Bacillus licheniformis
MRRIAAVLICLAVAMIVAGCQNEDEGKDRRLVAVENMLEAILDDDLSKMKRLYVEGANPSPETILKDKQKWGISGLHADDFQISEASIHVFHAAYKMENTGQPGTIAFRIRNDPDKGVMIDFIGYIKEAKKQENR

SEQ ID NO: 5539 - protein, 379 aa, Bacillus licheniformis
MASFQQYKTKTGYKWLFKMGVGIDPKTGNRKTTTRRGFKTKKEAVAAAAEFQKEIDNNALARNDITFEDVFKEWWDVHSKTIKRSTRYRKLSNFKKHILPHFGKLKIKDITRAYCQKVINLIAQDIDSVQNVKIQANLVFKYALRMEYITKNPMEFVVIPKKEENFLSQEEEKRNFWEKDEIKTFLEKAHSQLAPQDYVMFYVLIFTGMRKGELIALEWKDVDLKEKTINIKQTMFFENGKEVIQTTKKYHSKRIITIDDQTAQILKKWRTQQKEMLLSNGITSEAKYVLIRGDMRPLRLAYPNDLLNRMITKNKLHRITIHGFRHSHASILFEAGASIKEVQARLGHKEIQTTMNIYTHVTKTAKAKTAETFKKYMEL

SEQ ID NO: 5540 - protein, 159 aa, Bacillus licheniformis
MVYTKSHLEDWIENLYRSISIITPEQIDFERIAELLGISVYFKPIPSCSFKYNDVYTIILDSRKTRFEQWDDFAHELCHLYRHEGDKKTMPKFWSDYQERQANYFSYHFCIPTFMLHGMKIPQNHFFDAHLISKMFKVTEPFAKVRLNMYFNKIHLIVS

SEQ ID NO: 5541 - protein, 115 aa, Bacillus licheniformis
MKRTTEFVLGLIGGIFGFIGAFLALIVGGLDASFNSSGTSDIIGLGWGAIFLSILGIIASVIVRKKAKLGGILLIISGIGGLICIFLFYLLPAILLIISGVMGLARRDKTTTTAA

SEQ ID NO: 5542 - protein, 173 aa, Bacillus licheniformis
MKKFLVLFLSFGLALALAACSSTDDVSTGTEDSKDKKTEEKKDDGSKKVDASSQKTDALGMKVNLGDVKIMKDKVNVGINIENTTSKVLNFYPDQGNAVVGDMQLSANMFLTDGEVGGEVQGGVKQDGVLEFAVPEGKELDINNIKEIKLNFGDVTTEDFMNNKAVSFTVPVK

SEQ ID NO: 5543 - protein, 88 aa, Bacillus licheniformis
MENKEFEIILKEIQAINSRLTNLERNVATKDDIKTLSDKIDFQHTENINSDNLLLDEISALEEGVIYVNRKVADAEFEIHTLKTRIHQ

SEQ ID NO: 5544 - protein, 122 aa, Bacillus licheniformis
MKFGDRLRELRKMRPNLSQKKLGEHLGLAESTISMYEQNRREPEYEILIKIADYFDVSIDYLLRGTDPKVQDKIFEDEAKRILNDPKTFIAARDGEITQEILDAALEIITEQLKEGGKKKSD

SEQ ID NO: 5545 - protein, 78 aa, Bacillus licheniformis
MNKKVIGAKLMKLRGDKTRSLVANELEISESTLAMYESGHRTPRDEIKVRIANYYKKTVQEIFFEDQLHELHGKSHTA

SEQ ID NO: 5546 - protein, 108 aa, Bacillus licheniformis
MANLGISLDNLPNETVFEIVKALCEKAYQQGVEDGAKKYTYPPILKNTHLQEIFQIKSAAVTRLTGIESFPKLKTIQARYPRDLVFEWIKQNSTWVEENTNYFQKGVS

SEQ ID NO: 5547 - protein, 244 aa, Bacillus licheniformis
MNQLMNSEIKMTSLDLAELTGKEHKHIMRDIREEINKLGKELGESIFGLSSYKTLQNKELPCYTFGRKGAMQLALKYDATTRFKVIERIEQLEKQQQPKTPLEVLQGTINQLVEQDKRMNQLEGQVNNISNIVSMNNVGWREKVNVILKRIAKNWTGVEPYRSVMNLSYERLEQRAGCKLDIRLNNRKERALSQGMSKTYVKKINKLDVIAEEKRLVEIYIQIVKEMAIQFKVNINDFKLDEVV

SEQ ID NO: 5548 - protein, 172 aa, Bacillus licheniformis
MPEIVSKSLAHLLETKNMTNGQLALDLNVSESMVSKMKNGTRKMPWDVAETSLKKFDQPFFAMGIMNKFSDGCSPPVFTGESVEQHRLAFEEIMVTQATEAIQTLADVSFVKNPKLISLEERERIKVVIKELLDVEAWAKNLAALLAKEYNISLKECYKKATITWKAKGWLE

SEQ ID NO: 5549 - protein, 92 aa, Bacillus licheniformis
MNLNHFLKSDREKAERLYKSLQFLVSELLADAVKEGDFDGCIELAGSIVDHSRDLKKMQHPEKVVELHEIASEFAKRGLNVVPVKPPARGIH

SEQ ID NO: 5550 - protein, 62 aa, Bacillus licheniformis
MNHRKYELASSFLRNAKNMNYSEQDIKGAIRLLYEEVSSEEKVMLSLYKYLMARKGADGNEH

SEQ ID NO: 5551 - protein, 34 aa, Bacillus licheniformis
MNIEHPIITEINRYGYPKDYLRYEEEEENEDDEA

SEQ ID NO: 5552 - protein, 267 aa, Bacillus licheniformis
MDKIGESPLEDNESEAARLGNLLEDIVAQEFSRRKGLKVKKRNAILQHEKYPYFLANVDRLIVGRKEGLECKTATVYKRDEWTADSVPDAYFVQCQWYMSVTGFKKWHLAALILGDVVNPWRFHEIERDDELIRIMEEKAAYFWNEHVSKRVPPPFDGSQSSKDLLAAMYPEHVEDSVDLPGYFDSKIEEYERTKEKINELTEKKQAIENEIKGILGERKHGFVADKKVTWSRFPVERFDKEKFKREHPDIYRQYVKEGNGSRFSIR

SEQ ID NO: 5553 - protein, 273 aa, Bacillus licheniformis
MTQAEKLKNDIAKQEQRNEVAQDDKPKTILDAMMKHKESFEMALPKHLDADRLIRLAVTEFRKNPMLKECTPESLLGAVMQAAQVGLEPDALGSAYLVPYYNKNKNVKEVQLQIGYKGLIELVRRSGQVTSIVANEVYENDEFDFEYGINEKLYHKPTMDADRGKLKCFYAYARFKDGGHAFTVMSVEQINQIRDKFSKSQKNGKHFGPWADHYESMAKKTVIKQLVKYMPISVEIQNQITRDETVHSSFKEEPKPIYAFEESPDIIDAPIEN

SEQ ID NO: 5554 - protein, 235 aa, Bacillus licheniformis
MDMQGMGCVVLPRLPFKDERDEIIYDHLFKRAEYRQGKELDIGQTIIKITHLAERFNWSAVQIKYSLDRMARQGYLKIDRLPQKRGFIVTIVNYAEYTRFENYKKKKAPVSDPTEGKEEDKNMKTNPFQFFEDEGFGLLSSFLADMLKGLIDDYGEEKVLDAMKEAVKRNARNMAYVQRLLQSNELKSKEWGNDYQAKKARKQSDQYKHGISKGDAKPSGKISPLFGPGRIRRKG

SEQ ID NO: 5555 - protein, 326 aa, Bacillus licheniformis
MTIKQKKQENKAISINTAFQKVMQSLREKSAHFSAPDASGEKAEYECETCKDHGIVFYRVHKDTKWNYDERLKQLVPEEMVPEDDFLSGKVCPPEKAGEWKDTYSKQCDCVRRKRIARLMAASGITEEFEKLIFGNFKTEGKPKLIKDAYDCAVEYFKDFEKIRGDRSNSIALLGQPGSGKTHLLTAIMNNLIKKKSVHCLYFPYVEGMGDLKKDFDQLETKLDAMRKVEVLFIDDLFKPVYVTTSEGRIKKPRATEWQIEQIQSIVNYRYLNHLPLLVSSELTTDELLDIDEALGSRIHQMCRDYTVIIKGDMMLLNHRLSDLSD

SEQ ID NO: 5556 - protein, 70 aa, Bacillus licheniformis
MKLKPITINDDLSFTGTMEKGKVRVIVVDGNNGTAHAMDAPEHGKSIIQTVKGTFKRVDFEIGLKVEKDD

SEQ ID NO: 5557 - protein, 62 aa, Bacillus licheniformis
MTINLKVIQEKPKGLSVDDIQDGFFLVKGDNAWVIRSHARDFSLIDLGTFEIYAKNGFRGFH

SEQ ID NO: 5558 - protein, 38 aa, Bacillus licheniformis
MERLRRERQMKNIKRLIVRLIGRKKKEQKKVFEWWDLI

SEQ ID NO: 5559 - protein, 69 aa, Bacillus licheniformis
MRIIKKEVNSQYGGLFKKVFIRKMVKENDRELIQETSTTYIVGIPVRSVTETRPPSLKDAFKQAWGSAK

SEQ ID NO: 5560 - protein, 149 aa, Bacillus licheniformis
MDIIKIRYTFRHKGSGNIEMKRYNIGQLEERAAAKLSPVFSDEYELISRDLYTGLKDNTDREIYEGDIIHCVHWFFDGNEIEEHFTASVGFRDGSFTLENINSRYYSDYTFEENGKGICWIGDINYCDEDYEIIGNIYQNPDLLLEATE

SEQ ID NO: 5561 - protein, 151 aa, Bacillus licheniformis
MRERKYRAFVKQCNKMIYSENSYPKGNSDYRFVASEDHKKGLGVEYFTNRTEYVNQYGGVVLLPDWRVFTDEEAPVTEYTGLKDETGREIWEGDIRKDSLGRIFKVVFYDDLAAFYGEHPGGLIQCLADCGPDSEYLGTVYENPGLLEAAE

SEQ ID NO: 5562 - protein, 140 aa, Bacillus licheniformis
MITLNIPVEPMGAVRMTGRGKFVNKNAQRYLAYKDFIKLHAQKQMKGQQLYTGPTVVKVLFSMPIPKSWSKKKQQEAISTVHIKKPDIDNLVKGVFDALNKTAWHDDNQVFMVIGAKVYGKEPGIEVQIMGLAEWENLSA

SEQ ID NO: 5563 - protein, 68 aa, Bacillus licheniformis
MGKFKRLIIRYKNQYGRTVGHDTLWKGLDSLIELKRRYGFLNEDLEHVEIDGEECDLKKVRAALEKRG

SEQ ID NO: 5564 - protein, 94 aa, Bacillus licheniformis
MQKMLNRTVLVGRLTRDPDLRYVGDGKPVVSFTIAVNRTFKNQNGETEADFINCVAWLQHAQEEVIDLAVYLEAAIQKFDELEKKFDELEREKA

SEQ ID NO: 5565 - protein, 145 aa, Bacillus licheniformis
MKKLFKTIVTLSLLISGTLLFSQSAAAVWSPWQKEAFGHTARIFTDDTNYYSGAKTVDWRAEKKGSGTLYYTAGVYKKRSGGGLTDTNLVQRGYFKHSTPLKSFSVNEIRKRTGKGSYVIQIDCYTDAKKNNYVGTFESKTFYIK

SEQ ID NO: 5566 - protein, 138 aa, Bacillus licheniformis
MQFIELTLIGQAGKEKRGQMNKEQFTFEMELKGGLNGEKSDEKKRLEKIKESYSNCVDMALSEGETLPYYDIEVADMNFLIEQAEKGLTVTRSAGNLRALHECVTAMQKIKFICRRAKKTYIEEKDIDDILKILEGKV

SEQ ID NO: 5567 - protein, 151 aa, Bacillus licheniformis
MYKKEIEKLISSYHWMAKEVQRLQRVLYGSDIPMRSWGVAQYGLEAAMPKGSPGKSQAELRDMDIREERLYKRLEYFEERVYAIEAAARTIEGEQHKVIYDCMMEGMSYRAIGLHLGISRETVRRMKDEIINQLCQNCRIVQLLNPKKSVV

SEQ ID NO: 5568 - protein, 76 aa, Bacillus licheniformis
MGKVTGVYPGPNNGLIRWIEENFGEIDGYAATFKMKDGTTMTIYDALTPVEAVGMAEIGKNVIQEAINEDEFVSRP

SEQ ID NO: 5569 - protein, 235 aa, Bacillus licheniformis
MAEKHIQAQKDYVKGMKYKDLAEKYGVSVNTIKSWKQRHGWKRKKGAPIEKGVHTKKPGAPKGNINALGNNGGAPKGNQNAKIHGFYSKFLPEETLEIMEEIQERSPADMIWDQIQIQYAAIIRAQRIMFVQDKDDMAKELKKTKESDLSSEEEFEIQFAWDRHATFLNAQSRAMGELRSLIKQFDALAHEEDERRLKLDQMRLNIDKTKAEIERLNDDENDSTFEIIIKDKGER

SEQ ID NO: 5570 - protein, 424 aa, Bacillus licheniformis
MEKEVNPRFRDFLFDWSQKFYFLVGGYGSSKSYHVALKLILKMLQEKRTALVVREVYDTHRDSTFSLLEEIITDLGLDHKIRCVSSPMQIRFPNGSKIIFKGMDKPAKLKSINNVSIVWVEECSEVKYDGFKELLGRLRHPTLKLHMILSTNPVSKGNWSYKHFFKDEANQFFVLDDDELYKKKTIIKNNTYYHHSTADDNLFLPESYIEQLEDLKSHDPDLYRIARKGRFGVNGKLVLPQFEVMEHEKVMNAIRAIDRPILKNGMDFGFVDSYNALVRMAIDHNQKILYIYWQYYKNDTTDDKTAEDLKDLKRVLIKADSAEPKTIRFFRQQGFRMKAAKKFQGSRLQYTKKVKRFKKIICSDQCPDVIRELKDLTFAVDKDGNVIEDEFNIDPHTFSAIWYGLDDYEVSSLKGHGVTRRFRD

SEQ ID NO: 5571 - protein, 471 aa, Bacillus licheniformis
MIKFLDQIRTKGISGELISQIIEEHKDDHDRMKKLYDRYKAEPAGVPILQRKAVDYEDFETGRIKRIDHKVNNKLNNSFDSEIVDTKVGYLFGHPIAYEVDDKSKSGNVSAIKQLIEDFTLRNHVPDEDSEWGKMAAICGYGARLAYVDKEGKERIKNIDPWEVVFITDGNIHEPEYALRYYETCDGQLKAEFYDSTDIHYYSTKDSAVFEEDRIQPHMFKGCPLFGLANNKELKGDAEKVLSLIDAYDRTISDASNEIEQYRLAYLVLKGLGADDETLEKLKETGVLQLLEENDEVSYLTKDINDAIIENHLNRLEKDILRFAKSVNFTDESFAGNVSGVAMKFKLMALENKSITMERKMTAALRYQFKILFSAWGTKGKASEDDYLKVWFGFTRNLPVNLLEESQIAGGLKGLVSEETRLSLLSFVDDVQYEIDKMKEEQDEYTRHLSPLDDSEDKAPQDGEPDDEESE

SEQ ID NO: 5572 - protein, 305 aa, Bacillus licheniformis
MKNQNEIDKYLDEMIEKAERKIDQLFARRMKEIKNQIAAMYDKYSKDGELSYTELNKYNRFRKEMERMAAEIHKDYRELLKMINDLMEKQYVENYLRSAYLYEFEAQVKMGFTIPTVAVIAAALANPIEKLQLPNVLEAARDEIINNISIEVAQSLLAGESYTKMAKRIENRVNFSRAKARRVARTEAHRVQIAGRLKSAEKAAEKADMKKLWDSTLDTRTRIAHRKLDGKVVPFNGVFKSIYGGVGKAPGHMHNPKDDINCRCSIIFLVNGQKPERRISRINGKNVVIPYMTYEEWKKQLEKAG

SEQ ID NO: 5573 - protein, 48 aa, Bacillus licheniformis
MPKLTVILGGEVICRHNGMVHVAVTFDGSLSSIFVVSEADYERVFPNG

SEQ ID NO: 5574 - protein, 109 aa, Bacillus licheniformis
MAKLEIKLTEEARKRKEENPLSSVGLKFSDYDVLIDGHEPTHLTDLKLSMRVGELNEATVTFVVDEIDVDADFLAALEAKIEADKVAAASPEETTEDTTDADHSDEGSE

SEQ ID NO: 5575 - protein, 214 aa, Bacillus licheniformis
MPKYIKKPVEVEAFIFAVDDTPEWFLEKTKNSYCEFHYDSNGVRCILPTSEGSVMIIRAGDFVIKGVEGEIYPCESSIFEKTYDRVDPLKKARKMAELSGMLTKNGFDFTEKKSEIDNNEMARGKLESLKRAFEEGRIKSSSVTNFPIKDNYGQWQYGEAEYTFRVEPSAIAKEFVREVLSEKPVTMSLDGEEVGKACFKEVSKVMKRQNMRSK

SEQ ID NO: 5576 - protein, 193 aa, Bacillus licheniformis
MNLEEVKQFLDANKENEDVKAYLEELSAVSADKVKGFLETDEGQKLIRPKLDQHFTKSLETWKANNLDELVDAKVKELYPEETEEQKRIRKLEQELEKQQREAKREKLMNTAISYASEKGLPTDLVAYFLGDDEETTKSNLGTLEEKFSAFVNKAVEDKFRANGRDVEPGGGGSGSGENLNIGSLAEQASIRK

SEQ ID NO: 5577 - protein, 306 aa, Bacillus licheniformis
MSFDPNNVLMQDAVKGKVPSDQGTLVLKDFMTQSAVTKLAKYEEMDKTEKTFTYLASGPGAYWVGEGERIKTSKATWLEAKMTSKKLGVIVPVTKEFLNYSVKDFFTQMRPAIAEAFAIKFDQAALFGIDSPFGKGTSVFERAEAAGNTVVLNSLGNLYDELNAVMALTEDNDKDVNGFTTTRRFKQKLRGTKDGNGLPIFNDARGGATSEALGLPIGYVDSKSWDYTKAHLLAADWDFTRYGIPQGMEYHISQDATLTTVVDENNNPINLFERDMFALRVTQQVGFMTLSDEAFAALTPEAEAGA

SEQ ID NO: 5578 - protein, 112 aa, Bacillus licheniformis
MSFTSKNYRTSGGDKWVIGGELEVKAGAKVSGMPAGTPGPDSITSEMIGEGQVRNRNIGDGSVNSRNIGNGSVQNNHIQAKAVTLDKMGDDVTAKFTDIENRLKALEGSGGS

SEQ ID NO: 5579 - protein, 89 aa, Bacillus licheniformis
MKITDGSIVLSVSDKAYRVVYAPFGFERVEESEEVAQETDAPFDLFEMSKEQLTKVNKSDIITFLEQQEFEFDPNAKKDELIKVVLGEE

SEQ ID NO: 5580 - protein, 102 aa, Bacillus licheniformis
MDVQTIKTMLGITTDRHDAYLKEVIPLFIDFAKDYCNNRFLVDGAENLPAGVKLFVAKAIEFNMAPSNLSARSMGDVSYSYETELPESVLRHLKPYRRLRVV

SEQ ID NO: 5581 - protein, 112 aa, Bacillus licheniformis
MYEEFPHTITFQKFEQIPNGGGGFKKDWVDAITDCEAFVDSLTGKEYYQAQQLENPVEYNVYFPYREDVKNDMRIIWKDRNDRVLVIQSPPIDQGGQGEILCFKCRSGENIR

SEQ ID NO: 5582 - protein, 116 aa, Bacillus licheniformis
MHDRVKRIIAETAEIIAGQAVAAAPVDDGNLKNSIEVNYSHGGFKAKITVGASYAVYVEFGTGIYAEDGTGRKTPWVYFDEKLGRYVFTRGMRAQPFFFPAVEAGARYFERKMNRR

SEQ ID NO: 5583 - protein, 137 aa, Bacillus licheniformis
MIIQNKLASWNLQKAIYNRLSTDAALNEVIKGVFDNPNKDTPFPYVSIGEDTSTPFETKVTFGENITTVIHAWSRAEDGRREAKEILSLVMQALTKEPLEVEGFKPLQLSFLQSQVITDIDGITQHGILRIRIYINN

SEQ ID NO: 5584 - protein, 181 aa, Bacillus licheniformis
MAVSGKPTTGKSIIYIVQAANAPLGSDALIVGNQTEGTWTREQETVDEQTKLGRIVGYGAKSETFELSLYAQRKDGGQEALEWTYDNESELKVWRVDTSQKNDNGKYDCRFGWTIIENIEFSEPTDGFVEASTSLPVLVRTVPGEIELPDDFIQSANEILFEKPGETTGGFEKRKQPTSTP

SEQ ID NO: 5585 - protein, 112 aa, Bacillus licheniformis
MKFYSKNRARLQADSRKESSPLLLPEAPQNLQYTATTNSVTVDWKAVDGATSYKVYRGSEKVFYKEVTEPKCTLTDITPDTKLTVNVTAVNEVGESPMSQIETRTEPETSGS

SEQ ID NO: 5586 - protein, 165 aa, Bacillus licheniformis
MPTLEIEGKQYEARCDFKFERTAEEKYNEKDESGNKQGGLRNVYLGLLEQRSSLYLIRFWDCALSHLKDKKPSVEKIEEALAKVIEDEGAKGAERLYKEAFQAVDQSGFFAVQVKRIWQDFDVLKKEIKQRVGETEAEFLKRKQEREDAKEMMAELEKLRKEMNK

SEQ ID NO: 5587 - protein, 62 aa, Bacillus licheniformis
MNKKGRVTPKKMFDADKARKMVANEEDGWRNARSLGVNPNALKRATDALKTITLPDFNKKGG

SEQ ID NO: 5588 - protein, 1020 aa, Bacillus licheniformis
MIERLTAIVDAEIGKFKRKMGEVKALARSIPNRISVTVKENFKEAERRLGVFENRMARLSRVINDFQTVFGNAFSGMKMSIFPALVPAIASLTAALGSLGPVIGVASGGLMGLASSFGTAAAGAGAFGALAISNISGVFKASSDLAKLQQKLDETTDLKERAKIMEKIKAIQESLGAEERKALDTLEDFKANWREIAQETQKPILKTFTNSLNSFKSVLNTLRPMFKSVAAAGLELSESFQKSLNAPDVQKFFDYMNKNAGPQFATTVKTMGNYLRGFLNLLVAFGPLGQQMSQSMLKSSEAFAKWTASLSGSDKFKSFIQYVQQNGPKLLTILKNIGSGLIGMFTAFAPMSADMLTGLVNLTARFKEWGNSLSESKGFQEFINYVRQNTPTVLSLIGQLRDLIVNLGVGMAPLGSQILQMVTGFLKFTNSMMETNPIIGQMIGYLITFGGLFRALTPLTVAFSAAFKWKDAISTVKKLGTAIKWIGSVIGMVGKAFLTNPILMVVAAIAAAAYLIITNWKPISEFFVNLWEGIKTNAIAAWNSISEFFSGLWSGIVELASTAWGSLTSFFSRLWSGITTTAQAAWTGFMNLVKPIWDGIVAVFGPTFNVIVTTLSNIWNTVSSTVSSVWNTIKTTLIGVVTSIVDGVKNHFSILSQTLSGIWNGITSIAKGAWQVLKNAILGPVLLVIDLVQGDFKGFANHLKQIWTNISNGAKQIWNGIKTVVSSLVKGLVNAVKNYWNTAKTVTTTIFNGIKSVLSSIWNGIKNTVVNLAKGLWNAVKTTWNTFKTVTTTIFNAVKTVLTTVWNAAKSVVINAAKNIWSSVRNNFNNMKNVVTTVMKNVKTTIQNLWNNAVKFLKGIDLKQIGKNIIQGLINGIGSMANAVWRKVGDIADGVKKKITGLLNIHSPSRWMRDHVGKMIPAGVAVGIDKAGGLVEKATQKLAQLTMFTPDQTTFAYDTALSSGTLNDVRGQIEAEVSDFEISDRPIIIEMDGREVGRGTYKYVKEFQSREDGRRTTINR

SEQ ID NO: 5589 - protein, 267 aa, Bacillus licheniformis
MIDYKKILTTAIDDAFGQTIQEVDYWIKFNGYTLTDHFFVINDRGRGIVGRELNLVSLPGVDGAKLKGVRYTERTIEIDTLFIAANDAELRKILEEINYILATDKEEALIFSDEPDRTYYAVFSTAQESEGQNGVYKVTLTFVCPNPEKEAAETVVTTETNSPTVVKNDGKRAVTPTITCVFESDASTYEIQLLKEDETIEKRIKVNFNFIKGDTLVIDFEKRKVIINGKVNMNALLMLSRWFNIPVGEITVNTTHKSSISFNKAYM

SEQ ID NO: 5590 - protein, 1172 aa, Bacillus licheniformis
MADMWILDDKDKKQTIISSEAKEACRFYDAPFREELNVGSSFSFVADADHEDSVHIKPENQVVFEDRRGRKRNFVIKELEDADDGANARIRAYCEPALSELYDEFVTDIRPQNRTAQYVLDRILEGTRWRANVPVDLGLHSTNFYRISVMEAINQILQIWGGEYYDEVVFDENDNIVDRVIHILPRRGQDTGKRAEIDKDIQEITRTVLSYPVTALYGYGASLETEGGGNTRYIDFSDVEWVKANGDPVDKPKGQEWVGDPDLLEKFGRIMYDGQTKRHRFQKWQDDSIEDPAELLRKTYEALINHEMVQVNYSLKLELLEYISGYEHEAVDLGDTMIAIDDNFRHPIEVQTRVIAIEYDLSDPVNTAQVEMGQFLDLYSTEKRIKELETTIDTNRGKWDNGGDPIIGDGSFPDKVPPVPSNIKVESLFQGVSITWDYNPSSYIAAYQIFASPNKGFTPLDENLIFSGKLSGYEHTPGVDQVWYYRMRTINTHGTPSPFTQEFTGVTRRILTDDIVFGAVTAEKLANLSVTAEKLSQKFDESNILPGSVLRPGELGNVNGASWSVKEGEFNEVTVTRKADDTRAGFGFSAFYRSTLRLTKGEKYTLSFEVKRNNTLNINFIYLKDDSGQYQLDAPDFNDISSFPSDEFVRVDYVFQSPITTETARLWLGGNKVGDENPSVTYRKIQIRKGDVRKEFAFSPYDVMLTEQAVSSALIAKAAIQSAHIQEAAITTAAIANGAITRAKLGTAIIGTAQIEDGAITNAKIANLSADKINAGTIKGITIEGSLIRGARIEPLSSSSAYESYIEANKIYQLRKTRYGGYQDRYEELDISSGSIIQDYGNRLDDDSHESLNKVEISKGKVALSSGKTFSTGTTSRMEIFSQLGTSDNGLYGGNFITMYRNDEKVFELRQDSWTDPDTNVIMPQMSIRAEKVDFVSFFEDVSVYSEKSIYHSAERSVALFSKDGPVTVYAKDGMKLNRGSNGEYTTSITADDALKIASKGTITLEDTEFNGASLYLGTDSRGPRIWSYSINKRTTTAAANLHMDQYGTFHKVTSSQKYKINIEEFPNDRVENILKLNPKTWFDKKAVEAYAEILESGQEDDENKPYFERIPGLIAEEVFEAGLKEFVFFGKPDENGNREIEGIMYDRLFALLIPIVRDLKTRIENIESTLN

SEQ ID NO: 5591 - protein, 97 aa, Bacillus licheniformis
MRTGGLRGMAQTNELDVFKHEITELKADHKTLEQRVITLERASDRHDQQIMSINDKLNKIEENTTWIKRSITGAIITAVCTLVISGIAALFINFIQK

SEQ ID NO: 5592 - protein, 87 aa, Bacillus licheniformis
MTTFDKGTVVRTVLLFIALVNQTLIMFGKAALPISEDQVNTLADALYLAGSTAFTIITSVVAWFKNNYVTGKGKQQKEVLKQKGLTK

SEQ ID NO: 5593 - protein, 317 aa, Bacillus licheniformis
MGIKGIDVSHWQGNINWKKVAGDGIKFAFIKATEGTTLQDNKFVTNISGANAVGIKTGAYHFARFGSKSEALAEARFFLSVANKVHLTYPLVLDLEVNQRNVSKSVLTDAAVAFLREVEKAGYFAMIYSGKSFLENCLDESKLKPFALWVARYNNTLGRHADIWQYSDCGRVAGISGNVDMNICYRDGLRAQVAVTTEKAATVKPVSNKKPVKTETVYTVKKGDTLSEIAQKNNTTVKALQNLNNIKDANKIYVGQKLKISGSPSTASNKKQYYTIKSGDTLSGISKRFNTSIKTLQAWNGIKNANKIYAGQKIRVR

SEQ ID NO: 5594 - protein, 197 aa, Bacillus licheniformis
MYYVPHMYPYQYSYPYYVNVPMYNCRRQSVHRTVPSEVEHANKLSSVRSSKGSNSILLKDYGPEAFVVNINEATKQNNTYRTALWTGTHLQVTLMSLNVGEDIGLEMHPNVDQFLRVEQGQGIVQMGKNKDHLNFKRNVYDDSAIIIPAGTWHNLTNTGRIPLKLYSIYAPPNHPFGTVHVTKGDALASEEEYGHGN

SEQ ID NO: 5595 - protein, 301 aa, Bacillus licheniformis
MYPYPVYNPYIRNSDDFRMPPDRKLINDIHKAINGEHSAILCYKQIAENAPTEDIRKQILEIRQDEQRHFEEFSRIFTNLTGKKPIPIIIEECPKKYRTSLESAFKDEQETVDFYLDLADRIQNQSIKKVFQRAAADEQNHAVWFLFFLNTSSTQQTRQVNYGAKGALNSGRLTLPQMLTFAIQDEYLAQARYNEILRNFGDIRTFVQIKEAELRHINALLSLFERYQVQIPKDTSQLYVTTPVTLKDAYASGVQGEIDNIAMYNKFLTFDLPADARTVFTQLRNASLNHLEAFRRGLERN

SEQ ID NO: 5596 - protein, 236 aa, Bacillus licheniformis
MSEHIEVILRSILAFGILLVGSRLLGKQTISQMNIFDFIASITLGAITANLAFNTSLKIHHMVLAFFIFVFVILATAYISLWSQKGRKFFAGDPTVVIQNGKVLEHNMRKMRYTIDYLNQQLREKNVFKIEEVLYAIVETNGTLTVLKKPQFRNVTKKDLWVATTPEGKLPIELIMDGKMKNENLKDNQLTQAWLQSEMKKRGLSTDEVFYAVLSPDGNIYIDTYEDHIHSSFDKE

SEQ ID NO: 5597 - protein, 110 aa, Bacillus licheniformis
MTVEDLSYKDKKVISIGIVSELTGLSVRQIRYYEERKLIYPQRSTRGTRKYSFADVERLMEIANKREDGVQTAEILKDMRKKEQRLKNDQQLRKKMLEGQLNAHFKYKNR

SEQ ID NO: 5598 - protein, 51 aa, Bacillus licheniformis
MKEHKAVLLAKEIVALDNKRDELLETLMNLAGKDAFPLLRAVQNGFYQKSS

SEQ ID NO: 5599 - protein, 59 aa, Bacillus licheniformis
MSRLLKNALEKERNHYLKKLISLGEHNREVLQRMTITELRNEYFYFFRKNKARVQNRPF

SEQ ID NO: 5600 - protein, 153 aa, Bacillus licheniformis
MRLSFNEEEVHRAMSLYKVFARAFKSVSEHSIRDSKEHGFNPTEFAVLELLYTRGAQKLQQIGSRLLLVSGNVTYVIDKLEKNGFIKREQDPKDKRSVYANLTEKGKAYLDEIYPIHSLRIARAFSGLTKEEQEQLMVLLKKAGIHSQHLLFR

SEQ ID NO: 5601 - protein, 616 aa, Bacillus licheniformis
MGITMQPVLTTSAPSGGNWRYEVKYDGYRGLLKIAATGEVSLISRNSQPLENTFPEISEFAKSMIETLKEHLPITIDGEIVSLTNRFRSRFEYVQKRGLSKKAELIAQAAAKKPCQYLAFDLLVFNGESLTSLPYTERKRMLFDLMKELGLPMAPDPMAHARIQYIPDTSDFHDLWKAVKRFDGEGIVAKKKDSRWAENKKTAEWLKLKNYKKAAVFMTGYNMANRYLTIAVYDRGQIKEVGSVSHGLGEQERNAILSIVKQYGTETKPGEYTIDPSICMTVHYLTIHYGTLREVSFVSFEFDMAWENCTYNRLLLHSRNVHPDLQLTSLDKVIFPKSDKTKADYIGYLNEIGDFLLPFLDNRALTVIRYPHGSGGESFFQKNKPDYAPEFITSIRDDEHEHIICSDYSVLLWLANQLALEFHIPFQTVDTAHPTEIVFDLDPPSKSEFPLAVRAAKELHRLFDQLGLLSFPKLSGNKGIQIYIPISKNAFTYEETRLFTSFAASYCVSLFPDLFTTERLIKNRGGKLYIDYVQHAPGKTIICPYSTRGNELGTVAAPLFWDEVHSDLSPLNFTMEAVVKRTKELGCPFESFFRQPQDKQIKAILDHLKENNRSEN

SEQ ID NO: 5602 - protein, 287 aa, Bacillus licheniformis
MWKGSISFGLVNIPIKLFAATEDKDIKLRSLHKECRAPIQYEKKCTNCHQEIAPDDIVKGYEYVKGKYVVLSDDELKQLKEEQEDKAVEIVDFVQLKEIDPIYFNRSYFVGPGDNGVKAYSLLREALRKTEKIGIAHMTIRSKKQLAILRVYENCILMESIHYPDEVRNAAHVPGVPEETAVNEKELQTAISLIDELTTTFAPEQYEDTYRIALMDKIKEKIDHNEGVTPNAGAAAPREDVIDLVSALQASIERTKGPDREAAKAPAAKGTAEKKKKTSRKKASEAK

SEQ ID NO: 5603 - protein, 550 aa, Bacillus licheniformis
MTEVLGEYNGWLVLLSYFTAVLAAYTALDLSERVVHTKGRKNIGWLLAGSLTMGLGIWSMHFIGMVSFQTAEEMKYDLKFVLLSIVAAFAGSLISFYVVNEKKPTNGRLAAGSLAMGCAIASMHFIGMEAMENMTIVYHPVLYAASFAIAIFASFAALKLSVVFAKKTGSFRILFIKIGSALLMGGAISGMHYTGMSAATLFMADSVDTGYEGIDTVELGIMIVLVSLMLQCFLIFGAFNDKRLLLHIEKVKDNEERFQSLINHNIDPIYVFSLEGKLLSANSSGYSLLEKMGIEPERLSSVFRQEDHDRLLGWFLQVQNEKQAINRDTAIAIAEKRFDLNVTLIPVYVRKQLDSIYVICKDMTNQREAERKIHRMAHYDALTDLPNRRYAVDRLANVLKRQETGTAVLFLDLNRFKVFNDALGHDVGDLLLVAAAQRLAHCVPNEGFIARLGGDEFIIVAPLQGIDQLTRQLISQFETPFRIKEHRLKTSVSIGIAVSPDDGTDGDELMRKADMAMYAAKHKSVSRYRYFSSSLARKNRPSFQKEIELN

SEQ ID NO: 5604 - protein, 203 aa, Bacillus licheniformis
MAEAFKSLSYLGIFLALCIEFVPAEIVLPLAGYWVYQGDMSMFGVVAAGSLGGVAGPLTLYWLGRYGGRPFLERYGKYFFIKPEALEKSDRFFEKHGGFVAFSGRFIPGIRTLISIPCGLAKMNVWVFCIYTFLAITPITFVYVYLGFYLGENWSKVGSLLDGYLLPVGIGFIVLFVLYLWLKGRRNKIKSQSVSAFINKNKD

SEQ ID NO: 5605 - protein, 255 aa, Bacillus licheniformis
MDAALLLEYGWVLLILVGLEGILAADNALVMAVMVKHLPEKDRKKALFYGLAGAFVMRFGALFAISFLVNVWQLQAIGAVYLLYISVHHILKTHVFKKDEKVKETKQSGFWPTVIKVELADIAFAVDSILAAVALAVTLPATNLPQIGGLDGGQFMVILAGGIIGLIIMRFAASQFVNLLKKRPSLETAAFLIVGWVGVKLTLYTLAHPQINIVSEHFIHSGTWKFIFWAVLIAIALGGWFMTNPNKHENKAAEE

SEQ ID NO: 5606 - protein, 251 aa, Bacillus licheniformis
MKPVLSLLFKTGKRKQSLEESVISIQKGNQQLQNELIDQYKPFVAKTVSSVCKRYIDEKDDEFSIGLIAFNEAIEKYSSDKGNSLLAFAELIIKRKVIDYIRKEARNAQNINMDMQEGEEQESSQSMIEAELSIHEFNRMLEQEQRREEILHFKERLKSFGLSFSDLLEHSPKHTDARQNAIKVAYTLVEHEELKKILFEKKQLPVKQLEKLVAVSRKTVERNRKYIIAMAIIITGDYVYLKDYLKGVLNS

SEQ ID NO: 5607 - protein, 365 aa, Bacillus licheniformis
MRRGIIVEKNKKFVTLLTPDGQFLKAKSTEEDYEIGQEIAFPAETRMSRRRAGFFDLLSLRPLKAGVFSIAAIMLLAFMIIPDVLNNKAYAYMTIDINPSFELTLNKNCEVIDLVPLNEDGKALMDSIKNWEKSDFKEVISEIVEDSDKSGYVTESKEVLIATVYENNEDDTYKATVKSEIDDVAKKYEQQNYKMEAVESDLDTRAKAQKEGISTGRYIRSHKDELEDKNKDDDNENKKDDQNQEENTGEKEKAVKEEDQPEQHTDDKEADTEDHPDGEKPSDEDQSQPDQEMEKEKESNSLIPKTLRNITIMTKTVSRRRKERQKAVPVQIKRALNHLLTKRRKSLLTKRINKNIRRAGPANNP

SEQ ID NO: 5608 - protein, 65 aa, Bacillus licheniformis
MARTNKLLVPGAEQVLDQFKYEIAQEFGVQLGSDSVARSNGSVGGEMTKRLVQQAQAQLNGHNDK

SEQ ID NO: 5609 - protein, 239 aa, Bacillus licheniformis
MKPFKLTRLEMAKLMYALKGQLDVSPLAILLRSADLAPDEPEDNLDIPEFIARYERKKQKTEHGLSTNEIVELGNLCELTSLKSTAIQNWIKRDIKDLMGHPELGKKYSIDQAVILLIVRDLKSVYDFETIRPILTTIFNTITDRSDDVVSPLRFYEGYARVLDHVYQIKDYTLNKSALEKIVIEQTGQLRDFYKDLADPEWNKARDITAVTVLSVIASHIQATAHSMIDSVFLKYEMK

SEQ ID NO: 5610 - protein, 297 aa, Bacillus licheniformis
MGKRIFLFLLSNILVITTIGIVLSIIGSLTGVGTYFTANGGIDIVALLVFSAVVGFVGSFMSLLMSRWMAKMAMGVQVLNPDKQTLSYEEQQLVDRVYKLSRAAGLTKMPEVGIYNSREVNAFATGPSKNRSLVAVSTGLLQEMDDDAVEGVLAHEVAHIANGDMVTMTLLQGIVNTFVVFFARIAAWAVSRVVREELAPIVHFIAVIVFQIVFSILGSLVVFAYSRHREYHADRGGADLAGKDKMIHALRSLEQYTSRVKEEQASVATLKINGKKHTSLFSTHPDLSDRIRRLEAK

SEQ ID NO: 5611 - protein, 449 aa, Bacillus licheniformis
MKVLLRKLLRVLSPVQLIALYYFLAVTVSVVLLSLPVAHKNNVEWSFIDALFTAVSAVSVTGLTVVDTADTFSTAGIWILAFVLQFGGIGVMALGTFVWLIFGKRIGLKERRLIMTDQNQSNLSGLVKLMKHVLGLILLIELFGGLILGTYFLKYFETPGEAFMHGFFTSISATTNGGFDITGNSLIPFQHDYFVQFIVMMLIILGAIGFPVLIEVKDFLLSKERKFSFSLFTKLTSVTFFLLVIGGAIGIFAMEARFAFSGKSWHEVFFFSLFQSTTTRSGGLATIDISQFTHTTILFMCMLMFIGASPSSVGGGIRTTTFALNLLALFHFARGNKSVKVFKRELHQADLMKSLIVTLMAVILVFVSTLILTVTEKHSLLELLFEVCSAFGTTGLSMGITPDLSTIGKSVIILLMFIGRIGIVTLLYLFGRKEIEANYHYPKERIIIG

SEQ ID NO: 5612 - protein, 666 aa, Bacillus licheniformis
MKKRVIHLFIAAGFLLLAGACSNEPTAKESMDQYVDKWNEQKFEEMYEQLSAEAQKSISKDDFIKRNQSIYEQIGVSDLKVSTVDNDEDEKNKEKNDSVTIPYKVSMKTLAGPVSFQGKAKLVKEKKDGDTSWKVNWNQSFIFSQLKKGETIRITAKEPTRGIIYDRNGKALATNATVPEIGVVPGQLGDDKDGVIKKLANMLDMEKEDIEKQLSASWVTDDSFVPLKKVKPGSTELLKKATSLPGVLKQDTQSRYYPYGEKAAHLTGYIRPITEEELKQNKEGYSEHSLLGIVGLEHIYEKELRGEIGWTISIPESGATVASKDAKDGKDIHTTIDIKKQEELYSQLKDDSGAAVALEPQTGETLALVSAPSYDPNGFLFGWKKGEWEKLNKDASAPFTSKFNKTYAPGSTIKPITASIGLKNDAIKADEPKKIEGKEWQKDSSWGGYKVTRVSDRLSDVNLENALITSDNIYFAQTALDTGKDQFVEGLKSFGFEEKLDYEFPTKSSSISNEGIDSDILLADSGYGQGQMLMSPIHLAASYTPFLNDGNLIKPHLIKKDGEEKEIWHKNVLPTGGAEAITKGLKGVVEDPRGSAYKPVVKGLTIAGKTGTAELKTKKDEKGKENGWFTAYDYKNKNLLITMMIEDVSDRGGSSYVVNKVKKVFK

SEQ ID NO: 5613 - protein, 64 aa, Bacillus licheniformis
MDETTKERNVIMKRKVARNEAALNNKTPAESMHDHQYMTQYDAENGDRGANRNSKHGKQGESHQ

SEQ ID NO: 5614 - protein, 62 aa, Bacillus licheniformis
MKKHQKSKDMQNHKKPMNPDVLQEEFSNELGDVNAFKFIDVIENNKKKNKKADGQKRDKDKE

SEQ ID NO: 5615 - protein, 341 aa, Bacillus licheniformis
MANSRDSYFDNAKFLLIFLVVFGHIIRSYIHDNDALLHIYKFIYTFHMPAFILISGYFAKGFNRPGYVKKIAWKLIVPYLIFQGIYTLFYSFIDDQSLTAANPFEPQWSLWFLLSLFFWNLLLFPFTKLPAKWAFAASFAIAVLVGYIDMISNTLSLSRTFVFFPVFLAGYYLQKDHFKMLKGWKGKQAALAVLAATFVFYFFADFDYSWLFGSKPYSEFGDVGIKSGLNRVALLVITFASTFAFMALVPERRYFFTLWGTRTFYVYLLHGFIIKSFRKTGAEEWLADYQSLTLLFIATAILTFCLSSGFVKTVAQPFIELKMTNLIRLLKKDNGYNPYLK

SEQ ID NO: 5616 - protein, 736 aa, Bacillus licheniformis
MEETLDLNESLNLQNQLNRLRKENAKLKADLYQYELLFNGTLDAIFILDKQMNIIKANDAACKILQSQKKNLLNRSALDFLHAVPPDELNQNIHRFLERGYAKKEVAIRLDNGSVKYIEFTASKGIGEDCFFVVMRDISSKKILERERTINEKLFKDLFHRAVEGIVIFDKQGCFIDANHSFCQSFEIEKSELSKLKLSQFVSPENKGRLDKIWNALFRRGKAKGELPVRLRSGEDRLFELTITSNILNGFYMSIMRDITEKRSMEKQLFKSEERFREVFENAMDAIILMNNDGRIVKANQSACKIFELPMDQLLNKKMTDFIDRTDQRYHAIQKQYDQKGEIRAELLFRMANGQYKELEFTSKRIMFDSQDLTILRNVSDRKRMEQELRESELKFRKVFNGSMDGIVLFNNQYDIIDANPLAGKILSIPLEQLKTSNLLDVISGYHIENAASPAKTISFEEMDNDIPFLLSDQKRILEFSFKRNIIQNMNLAMLRDVTERKELEERLRKSDTLHVVGELAAGIAHEIRNPMTALKGFIQLLKGSIQNEDHALYFNVITSELKRIESIITEFLILAKPQAIMYEEKNIVKIMQDTMDLLHAQANLDNVQMHLKCEDGIPLIYCEPNQLKQVFINILKNAIEVMPDGGNVYVSIKPKGDDHIIVSLADEGIGMTEDKLKRLGEPFYTTKERGTGLGLMVSYKIIEEHKGKIEVESEEGRGTTFHLTLPIRQQHEEEA

SEQ ID NO: 5617 - protein, 165 aa, Bacillus licheniformis
MGFYIEMTSPFGQAYIVEENNHITHLLFEKEELKQLQQDGLELRPAETELLKEAKRQLEEYFQGERKTFTLPLRQDGTPFQKKVWEALQSIPYGESRSYLDIACAVGNPKAVRAIGQANKRNALPILIPCHRVIGKNRSLTGYSGNETDKKAVLLDIENIAYKGK

SEQ ID NO: 5618 - protein, 37 aa, Bacillus licheniformis
MKTNRPKKIAGYAELFVKLHVLTEEQKKDIIKSIKIR

SEQ ID NO: 5619 - protein, 353 aa, Bacillus licheniformis
MPEQFAVPRSVEWEETSVKILNQQKLPEKTEYLHLTTKEDIYDAIQTLKVRGAPAIGITAAFGLALCAQSIDTSDVSAFLRELRKIKDELNQARPTAVNLSWALNRLLKSAEGAKSVNEAKTNLVHEAIQIQVEDEETCRQIGQNALHLFKSGDSIMTICNAGSIATSRYGTALSPFYLAKTKDLDLHIYACETRPVLQGARLTAWELMQGGIDVTLITDSMAAHTMKEKNISAVIVGADRIARNGDTANKIGTFGLAILAKAFQIPFFIAAPLSTFDVSISCGDDIPIEERDPDEVRRINGTQIAPQEVPVFNPAFDITPHDLISGIITEKGIITDRFEEEIEALFSAEALT

SEQ ID NO: 5620 - protein, 398 aa, Bacillus licheniformis
MTVTKTAAYETLTESSAAALAVRLGLFPSKSTLTCREIGDGNLNLVFRVYDKEQQRGLVIKQAVPYAKVVGESWPLTLDRARIESSALIRQAEHVPHLVPKVYYSDTELAVTVLEDLSHLEIARNGLIDGKDYPHLSEDIGEFLGKTHFYSSEYALDPTVKERLVKQFTNPDLCDITESLVFTDPFFDHETNDFEEELRDEAEVLWGNEALKIEAAKLKQRFLSAEETLIHGDLHTGSIFAGEDGETKIIDPEFAFFGPIGFDIGQFIANLLLNALSREENRRAPLYRHVETVWNTFSRTFSEAWENDAVETCKHENGRLESVLRQAFEDAAGFAGCEMIRRTIGLAHVADLDTIVPFSRRISQKKLALKIGAAFIEKRSGFRTPKDMIEAFRNALKE

SEQ ID NO: 5621 - protein, 259 aa, Bacillus licheniformis
MKLTISCLQFDIAYGNPSENFKKAEQLIEQESRKADILLLPELWTTGYDLKNLGSIADEEGRQTKRWLQETAKANRIHIVCGSVAVKKKSGVYNIMYIADKNGHLIKEYSKAHLFQLMDEHLYLSAGSGDGRFELEGMPAAGFICYDIRFPEWIRKHTSEGAGIIFVSAEWPLARLDHWQSLLKARAIENQCFVAACNRSGKDPANEFAGHSTVIDPLGRTLAEAGRGEAVIRAEIDLRDIEKARGQIPVFEDIRKDLY

SEQ ID NO: 5622 - protein, 396 aa, Bacillus licheniformis
MKFEHSDVLKQLPEQFFASLVKKVNEKIAAGHDVINLGQGNPDQPTPEHIVDTMAQAVRNPENHRYSSFRGSRSLKEAAAAFYQREYGVELDPEREVAVLFGGKAGLVELPQCLLNPGDTVLVPDPGYPDYWSGVELARANMETMPLTADNQFLPDYSRIPKEVKEKAKLMYLNYPNNPTGAQATSAFFEETVRFAKSNGICVVHDFAYGAIGYDGKRPVSFLETAGAKDAGIEIYTLSKTYNMAGWRVGFAVGNASVIEALNLYQDHMYVSLFKAVQDAAAAALLSDQACVQEQNERYEKRRNAWIRAVRDIGWHADAPQGSFFAWMPVPDGYTSEAFSDLLLEKANVVTAPGIGFGKHGEGYVRVGLLTSEERLREAASRIAELNIFKKTGHSH

SEQ ID NO: 5623 - protein, 405 aa, Bacillus licheniformis
MSELLATYILADPGCDAEKRAEQIAIGLTVGSWTDLPLLKQEQLKKHKGRVVNVEETESELGEKQATVTIAYPEANFTNDIPAVLTTVFGKLSLDGKIKLADLEFSRSFKQSLPGPKFGVYGIRKKIGEFERPLLMSIFKGVIGRDMEDLKEQLRQQALGGVDLIKDDEILFETGSAPFEKRITEGKKVLEEAFEETGRKTLYAVNLTGRTMELKAKARKAAELGADVLLLNVFAYGLDVLQSFAEDDDIPLPIMAHPAVSGALTSSPHYGFSHSLLLGKLNRYAGADFSLFPSPYGSVALPKRDALAIYDECTKEDVFKPTFAVPSAGIHPGMVPLLMKDFGIDHIINAGGGIHGHPNGAAGGGRAFRAVIDAVLEAEPVEEKAKRSPDLKLALEKWGRVEVSV

SEQ ID NO: 5624 - protein, 427 aa, Bacillus licheniformis
MRKPLIICDFDGTITTNDNIISIMKQFAPEEWTALKDGVLSKDISIRDGVGRMFNLLPASLKEDITAYVLKQAETRPGFKEFVSFLDEKGLPFYVVSGGMDFFVYPLLEGIVGKDRIYCNEAAFTSRNIEIRWPYPCDGGCGNDCGCCKPSIIRRLKGRDDFVVMIGDSVTDVEAAKCSDLCIARDYLLRECEELGLKHAAFGDFRDVRRILEETAEVKEWMSEQKRQELAEVKKELAERDWFPATSGNLSIKVSEDPLRFLITASGKDKRKETEEDFLLADEEGRPAETGHALKPSAETLLHTYVYQHTNAGCCLHVHTVDNNVISELYAKEKQVTFRGQEIIKALGLWEEHAEVTVPIIENSAHIPDLAADFAGHLSGDSGAVLIRSHGITVWGKTAFEAKRMLEAYEFLFSWHLKLKALQAYHV

SEQ ID NO: 5625 - protein, 179 aa, Bacillus licheniformis
MATIRIHDEQNTSIENQEEVEQFLKRQEVIYEKWDITKLPAGLKEKYDLTDEEKQEILDVFAAEIKDISERRGYKASDVISLSDQNPKLDELLKNFKQEHHHTDDEVRFIVSGHGIFAIEGKDGTFFDVLLNPGDLISVPENTRHYFTLQEDRKVVAVRIFVTTEGWVPIYEKENVNQS

SEQ ID NO: 5626 - protein, 154 aa, Bacillus licheniformis
MENNKILGINHLLFSVSDLSVSISFYEKVFDAKWLVKAEKTAYFDLNGIWLAFNEEKDIKRQEIHDSYTHIAFSIQQEDLPFWEKKLHDLGVNVLKGRKRHEGDRDSIYFSDPDGHKFELHTGSVFDRLQYYQNEKPHLSFHEGHIKALYDRNK

SEQ ID NO: 5627 - protein, 109 aa, Bacillus licheniformis
MRQMMKKPVSKLRTVFAVKEAYSGLLLFFRAFRAWRKGDYPLFPKKTILLAALAFIYVLSPIDLIPDVLAGVGWLDDAAVLAFLFRQITKELDGFETHLTGRVNYNGKQ

SEQ ID NO: 5628 - protein, 80 aa, Bacillus licheniformis
MQRYIEKEALLVSISKKRQMMVEAAEIYGYTGDETIRRSQELDQLIYEYQKLSMNENAPDNLLQDFLGCIDCLPVEKYTA

SEQ ID NO: 5629 - protein, 503 aa, Bacillus licheniformis
MRNLKSIWKKIRLYLILVMIPAFIISFFVYEQERENITEKHRQTATLMLNIHRNQINYLIGETEARLSSLATALNHPVNEQHIKRILTETYKKEPRFSALYLLNEDGDVMVSTSPAKEKKALSYKSILQKAEKSKKSVITDDIHTVSDGLELNIFTPVFDSEGRTTNFLLASIRVDYLKNIMNVLSPELYIKILNQKNQIVFTAGHSPPEKPDGGTVDAFLDQIDWKLEVYPEPVQLDEIVHSLLLSFLSIFILLNIMFLLLQYVLLKRRTKQERAQNEAQKLELIGTLAASTAHEIRNPLTGISGFIQLLQKKYQSKEDQMYFSIIDQEIRRINQIVSEFLVLGKPTAEQWQLNSMNEMIDEIMPIIHSEANLYNVEVEFQDCGEDPAYVYCKKDHIKQVVLNVAKNALESMKNGGKLVIQIEHDQEKAQIIVKDIGEGIPQEMMESIFQPFVTSKEKGTGLGLVVCKRIISMYGGTIHIESERHKGTTVTITLPTSKEQDD

SEQ ID NO: 5630 - protein, 125 aa, Bacillus licheniformis
MNKHIHHHGLNPTEFAVLELLYHKGDQPLQQIGDKILLASGSITYVVDKLEQKQLITRRACTTDRRVTYAQITDKGTELLEKIFPGHAEELHNMISVLSDEEKEACIEMLKKVGLNARNIYKGKE

SEQ ID NO: 5631 - protein, 259 aa, Bacillus licheniformis
MARKKKHKKDHEEHVDESWLIPYADLLTLLLALFIVLFAMSSIDAKKFDMLSKSFNAVFTGGTGMMDYSSFTEPKTSTTEDGKSPDQAKDLSEAQKEKDKQSLKKIQEQVNRFIKEKNLQKQVNTKLTDEGLLLSIEDNIFFDSGKAEIRQQDIPLAKEVSDLLVLNPPRNIVISGHTDNVPIRNSQFKSNWHLSVMRAVNFMGLLIENPKLDAKIFSAKGYGEFKPIASNDTEEGRRKNRRVEILILPIGQENLNKKE

SEQ ID NO: 5632 - protein, 267 aa, Bacillus licheniformis
MDKTSLIGIILAIIGVGVGMVMKGVSPSVLVNPAAWLIILVGTIAAVVIAFPIRELKKVPKLFGILFKEKKMIEINELIPMFSEWAQIARREGLLALEANLNEIDDEFLKNGMSMAVDGQSADFIRDVLTEEVEAMEERHQVGAGIFTQAGTYAPTLGVLGAVVGLIAALADMSDTEALGHAISAAFVATLLGIFTGYVLWHPFANKLKRKSKQEVKVREVMIEGILSILEGQAPKVIEQKLLMYVSPSERSSIVIPDGDKGDSSNG

SEQ ID NO: 5633 - protein, 698 aa, Bacillus licheniformis
MRCQHCQKNEATIRLNMQINFTKKQMDLCEDCYKELTQPSMFSGNHFFGGGGSFFSQPSQAQTQTAAKKGLLDELAVNLTNAAKTGLIDPVIGRDDEVARVIEILNRRNKNNPVLIGEPGVGKTAVAEGLALKIAEGDVPNKLKNKELYLLDVASLVANTGIRGQFEERMKQLMKELKERKNAILFIDEIHLLVGAGSAEGSMDAGNILKPALARGELQVIGATTLKEYRQIEKDAALERRFQPIMVHEPTIEQAAAILNGLKEKYEAYHDVTYTDEAIKACVILSSRYIQDRHLPDKAIDLLDEAGSKANLKIDTVSGEQASQRLQEIEAEKAKALQEENYELAAKLRDEEEALHKKMESHEEEKRATVEAEDIQAIIEQKTGIPVGKLQHDDQKKMKELEAHLSSRVIGQKEAVKKVAKAVRRSRAGLKSKNRPVGSFLFVGPTGVGKTELSKRLAEELFGTKDAIIRLDMSEYMEKHAVSKLIGSPPGYVGHEEAGQLTEKVRRNPYSIVLLDEIEKAHPDVQHMFLQIMEDGRLTDSQGRTVSFKDTVIIMTSNAGVSEKRTTVGFNREEQVMGEQSMIDSLSGYFKPEFLNRFDSIIEFQPLEKEDLVKIAALLLKELEETLKEQNMTLEVSDEAKEKIAEIGYHPAFGARPLRRTIQTAVEDQMTDLLLEEEHIKGFAVIVENDEIRVKTTR

SEQ ID NO: 5634 - protein, 344 aa, Bacillus licheniformis
MSQSQGSAFQLAFVYVGTVVGAGFATGREIVEFFLRFGWPGLAGILISGLMFTFLGAKMMLIAVRINAKSYQELNKYLFGHTLGKFVNVFMLVVLLGVTSVMLSGAGAIFEEQLGFSNQAGMIATIALSLFVMMKGVKGIFGVNVIVVPLLLLFTVVVLFDSFIFRGPEIHNLAAFSANPDWILSAVSYGAFNLSLAQAVLVPIASELKSERLIIKGALIGGVLLTLVLVASFLSLSTLPDALLYEVPMAQVVFIVQHSVHIIYLFIIFGEVFTSVIGNLYGLEKQINEYIHIKSLYVFIFILLTIYLTGQIGYGKLISTIYPLFGQLSLVFIFFLIVKRVPER

SEQ ID NO: 5635 - protein, 219 aa, Bacillus licheniformis
MKQEKAIVVFSGGQDSTTCLLWALRQFQEVEAVTFQYNQRHKQEIEVAKKIAAKLGVKHHLLDMELLNQLAPNALTRDDIEIEAKEGELPSTFVPGRNLVFLSFASILAYQVGARHIITGVCETDFSGYPDCRDEFVKSCNVTVNLAMERPFVIHTPLMWLNKAETWELADELDALDFVKNETLTCYNGIIADGCGECPACKLRANGYNEYMKMKKERA

SEQ ID NO: 5636 - protein, 146 aa, Bacillus licheniformis
MLTQIYPQPSHPYSFELNKDMQMSAAHFIPREDAGACSRVHGHTYTINITIAGDELNASGFLVNFSTIKKLIHGEYDHTLLNDHQEFSGESADRIPSTEVVAKTIYDKVEAYLKDLNNRPHCVQVFVRETPTSYVVYRPKPGVQHG

SEQ ID NO: 5637 - protein, 243 aa, Bacillus licheniformis
MAKPIPVLEIFGPTVQGEGMVIGQKTMFVRTAGCDYSCSWCDSAFTWDGSAKKDIKWMTAEEVYESLKDIGGNAFSHVTISGGNPALLKQLDGLISLLKENGIRTALETQGTFYQDWFTGIDDLTISPKPPSSNMKTDFNRLDHIVDRLKEHGRAAAASLKVVIFTADDLQFAKQVHQRYPDIPFFLQVGNDDVHTEDQERLVERLLQKYEQLVEAVTRDPELNRVRVLPQLHTLIWGNKRGV

SEQ ID NO: 5638 - protein, 165 aa, Bacillus licheniformis
MTTRKDSELEGVTLLGNQGTNYLFDYSPEVLESFPNKHENRDYFVKFNCPEFTSLCPKTGQPDFATIYISYIPDKKMVESKSLKLYLFSFRNHGDFHEDCMNIIMNDLIELMDPRYIEVWGKFTPRGGISIDPYTNYGKPGTKYEKMAEYRMMNHDLYPETIDNR

SEQ ID NO: 5639 - protein, 352 aa, Bacillus licheniformis
MYMRGRRRPAIKHSEKNTYESKTLSDVCKQICNVKMSEGLTKETIDRYRRVCESVEEFAEIKGLSTSVESIDVEFARQYMTYILHEKKTFKGHRYKPESVKTPGCSPKYANDHLKTMRAVFTFCIKENMISENPFQKINKVKQPEPVIQILSVEEMKQLLKTPNKRKFSEFRDYVVMMCLINSMCRIGEIVTLEIENINFELSYIILEAQKTKTRKGRMIPLDKNTMQLLKKLLLRNTRFKPSKYVFITEEGTRLTTDNFRKRLADYAHQAGINKRVHPHLFRHTAASMFLQAGGDLRHLQTIIGHKDLRMVLRYTHLSLESLARQQSEYSLINQVVDGLNKPRKTKRKYGR

SEQ ID NO: 5640 - protein, 238 aa, Bacillus licheniformis
MTQKKKIFSVEESLPDLSGMFNNISASPNPKQITIEKALTIILRQMEVSGNRERTISDYHLHVSHFKESEELTYLHEITYKSIHSWLGNMDVSAQTRLTRLKCLKAFLSRCFDNGWFESKFWKNVKVKVDNKVKEGATDQEIKILLSLLDLTDFVQLRDATALLLMYKTGMRVGTLANLKEEHVDFNGELLRLSGEIVKNREPLLLPFDETLAQLLSVLVNKNAEIRRAYKKDNKFVF

SEQ ID NO: 5641 - protein, 110 aa, Bacillus licheniformis
MENFNKLASLNNLNGDQEDTLFIRRNQLQMLKTGMRVTAATKLEGIKTTLRPKFKIGDIQKEMNSVYSSLLYSFEGKAQEALAQRISQSAQQLINTEKDGESFVNGFKTR

SEQ ID NO: 5642 - protein, 479 aa, Bacillus licheniformis
MSKKIKKSNLTDETYYRISQRSYNYDYLRKKLKNKEYIRINSSVSGATYWYVDKIKTDEDTGLDAAVLSQAENKNGKWVKSDHPKNVVVAFAGTDPGKDPLSDVEQADINHIVLGNDPKDKTQYVVKKDAKDMSKTFGRYIGSMEQTAMLESGDYKLITKTSQIDQADQLVREVKQKYKGTSTVISTTGHSLGGAEAEYSAVNNDIYAVAFNSPSIVHLHSDEKQKEINNGDYNSYVKSIINPDDMVGAGWWDEFDRHNGTTIYTKDPSIATANREERLDGNKLQQVGRNLLYFANTLIFQNPDTHGINKSNFSFDENGNVQNIEGDELVYDKNLKAMLPPEVASGSGAIKVTPEVAKQLAQKVNAIIDDLRTMKREAENAYQEHDAEINDLKHDTYRQVGHGLYDKLTLEDVNNTLKNLAQSFDKKGNPLFYDVHAEKAYIASLKNTISDLEDISGYLAQIAKDFKSKDKMLANWLKL

SEQ ID NO: 5643 - protein, 85 aa, Bacillus licheniformis
MKHQYDVKKEETVLFEKAKTKMTEYLHNEYKGIDTITYYDDYFIDPTGAITVEGYLNGDKSKEFDGLYDPASDKIGSSSVDAEEK

SEQ ID NO: 5644 - protein, 269 aa, Bacillus licheniformis
MFIWPMLLESAKEPFNSDDYITETKFDGIRLIASRNNGLIRLYTRHNNEVTAKFPELLTLDIPDETILDGELIVPGSTGAGDFEAVMERFQSRKSFYPIVFCVFDVLRIEGVSVTSKPLSERKELLAGLKLDHPNVKIVEGVRGHATDYFELVRENKIEGIVMKQANAPYAENKRSDRWLKIVNYEYTDVLISGLRKEDNALLLSYLDGQYAGIMEFMPYDARRKFHAERLIVEETEKYAYIEPIGCRVKHRFKTKNGLLRIPSFHEWR

SEQ ID NO: 5645 - protein, 112 aa, Bacillus licheniformis
MTMNKTKLLTAILGLSLAGNAALGIYAAKLNEDVDIAYRVADDMAAEAEDAQETIEREYIVEDKDYAVSADDGGFSFDPQATDAKPGDRIIVTFTKDQYENGSGFKAIKVIE

SEQ ID NO: 5646 - protein, 66 aa, Bacillus licheniformis
MTLYIKRLWSDTPPLKPQQTDQLLDLYQRPVATFKDAGKAYQIGFNTALTCLGYLIANKYGGNDDE

SEQ ID NO: 5647 - protein, 95 aa, Bacillus licheniformis
MAKYKKKPVVVEAFKYGAPWPDWFHDKVTSNDVITHAAYESGSPFERNTGLWCEIKTLEGVMIAKEGDYIIRGVEGELYPCKPDIFEKTYERVDE

SEQ ID NO: 5648 - protein, 86 aa, Bacillus licheniformis
MAESKRESIGKIKIDLDVSDAITGLKAVQREAKAATKALAELREEQAKGHLAGRLYIGEEYIAPPVYVDGKKIEEASTKIFRKGER

SEQ ID NO: 5649 - protein, 124 aa, Bacillus licheniformis
MCGKITVKLTAGDEYDEQLDQLRQAFFALSDGPEQEEWRLALVVGRTVSEAKTIWKRVKTNYPSYKYTQFVSRNPYVLDGINPEYVALFMLPGCADNPIVNDPMFRWVIDNAYEVTCVEEGDGV

SEQ ID NO: 5650 - protein, 62 aa, Bacillus licheniformis
MNGLFYCYSTTLMHFLKANGRRYKFTKLHPRTNNRMWVFERDADFGALLDEYDARKANAKAQ

SEQ ID NO: 5651 - protein, 204 aa, Bacillus licheniformis
MEYRLNLAKFSILETLEKAAVDRELVYVRAGQRCLGKTTALIEFARKHDCEIMVHRNMLGYYKTEHPDVKVRSHLSEKWVTPSDRFVCDEGVPQDAIDELKRGGNLITGFVRVKDSFRDGLYDQLIRENTPNLLTIELTDEQSIPRVIYKGEEITGRIAVDFEWRTKDADQCGSTYYRIKHTKDSTGAPVVETKELAVGERAYE

SEQ ID NO: 5652 - protein, 112 aa, Bacillus licheniformis
MSNYYDKHKRDPEARAFYKSTAWAKCRALVLKRDHHLCQDCLANKTITKAETVHHIKELREYPELALDASNLVSLCNSCHNKRHPEKGQKSAKTEKKQRKIRVVKTEANPEL

SEQ ID NO: 5653 - protein, 107 aa, Bacillus licheniformis
MAVPTAKKIREYLGDRYKESDEELIELYVDTHKFYRRLKKEVAENPLMMRHTNKAGAENLVKNPLAIELTKTVTTLNNLLKSLDLTPAQRKELNAGGEENDDGFDQL

SEQ ID NO: 5654 - protein, 593 aa, Bacillus licheniformis
MTTVSISSNPTDIEKWYKNWLKTQKIAGFIREKPAEKLLTTWYAEKVVSGEIIASKKNILACKRHLRDLKRAGTDEFPYVFNEEKGHRPIQFIEKFCKPSQGQYNSLTLQPWQHFVIGSLYGWVHRDTGLRRFREGLVFVARKNGKTTKISGLANFAITKDDEPGARAYVLANSKQQAGVLFEESRAMVQKSPVLRKRLRENQKGIYHDASMSQIEARASDSEKLDGLNTHLGIFDEIHEFKDSKLISVIKNSRAARRQPLIIYITTAGYQLDGPLVEYYEIASDVLDGSNVQERNFYFMAELDDISEVENPEMWIKANPNIGVTMDIPSMIQDFNADRHVPREYNDWLVKRFNIFVDNGEESFIDFEVIKSNNGHVDPESLRGMRCIGGFDLSQTEDFTSACLEFLLPDNRVFVMSHSWVPAAKVQKDNEKIDYRGFEADGFLTIIPGNYVQYEYVYDWFVEMSRKYQIDKITFDPANAMRLVHDLQNYGFQTEVVRQGYITLSDPLKHIKELLLDGNVVYNENKLFTWYLNNVKLVEDRNGNWLPTKQTRYRKIDGFAAFLNAHTQVYLDMTKPVEGGSVGFISISDLLNG

SEQ ID NO: 5655 - protein, 432 aa, Bacillus licheniformis
MGFWSNVRNFFRKPSDVKAETRRDLTHWYIPRATILGNYGEHALADNETVFSAVSRLSNTMSSLPIKAYKNYQPIESQASELLTYAPNHNMTSGQFIGLLETHRAVYGNAYAIKRYGMRYEVVGLEVLDPSRVQPVIEETTRDLWYEILGDNGNYFVHNMDMIHVKNTSVDGLKGISPLKVLRNALDFDRDVRLFSLEQMDGAKISFILELANQLDDTRKEKMLENFKSFYKDNGGLLIQEPGVKIRELKKEFIDTKAFEVEKVTRSRVAQAFNIPLYMLGETQGSVSNMEQLYIDYVQGTLMPIATQYEKEFNRKLLTEKERKSGYYFKFSMNALLRGDMQTRGNFYQQGIRSGWFKPNEVRAWEDLPPEEGGDTLYLSKDLFPIDQVAQQKITSADAPTPPSLEINEDDNEDSKGGEDDKEVLGNQSGEE

SEQ ID NO: 5656 - protein, 248 aa, Bacillus licheniformis
MRTIKKFWEIKAAKNDAKTGEIYIYSEISSAQFWGDEVTTQTFKEDLDGLGEVSALNIYINSPGGSVFEGNSIYNIIKRHKAHVNVYVDGLAASIASVIAMSGDAIFMPANAMMMIHNPWTVAQGNAEELRKQADDMDRIRESLIEAYLGKAGEKLNRDRLIELMDAETWLTAQECLELGLCDSIEAPSAAVAKVDTQLFAKYRNTPESLLNQTKEDEKQAEKERLFREQLIAEAQTNLLKLQNGGII

SEQ ID NO: 5657 - protein, 384 aa, Bacillus licheniformis
MELFDLKANLNTVGTQLASVEKEIMNKAADPNASIDEVRSLKQKRDDLKERMDILQNQHDTLEREQKAKIQASLEKAKAGASAGLNSEDPKVKKISAKAGLIRATMRKEVPAPEVRAALGDNNGTGGEKLLPKTVSEELIHEPFVKNPLRELSTYTSVTNLEIPKVDFSLDDDDFIQDLQTAKELEVDGDVVTFGRRKFKVMAKISETILAATDTDLVATVERALQSGLAAKEKKVSFAVTPKQGEEEMSFYAAGIKQVTAEDKYKAIKKAIADLPEDFRENAKVMMTYADYLEIIETLANGSATLYGAQPEQIIGKPVEFCDAAVDPIVGDFRYSHFNYDPAITYESDKDVKTGENVFVLTAYFDHKIKLKSAFRIAKVDTTP

SEQ ID NO: 5658 - protein, 165 aa, Bacillus licheniformis
MSLSWDAVAFVGGIKEYEIFRDGVSVGTRVGTSFNESGLKPETTYKYQVRAISMAGNPSELSDELSVTTEPTPVPDPESISVSPSSKTLNVGETQQITATVSPSGADQGVTYTSSNTSIATVTSSGKVTAVAAGSATITVKSKVKTTVKNTVSITVVDPAPSGGE

SEQ ID NO: 5659 - protein, 79 aa, Bacillus licheniformis
MDISLDEVKEYLRIDGDEEDSLISFFISAAKTHLENAGVTDKESELYKLAVLIYVTDAYENRSTALSGNKVAGIVLQLR

SEQ ID NO: 5660 - protein, 111 aa, Bacillus licheniformis
MKTGDFNKRITFLRFTETTNGEGFEIKEWLPVATVWSAVKTVQGREFYQAGAVQADRTARFVIRYSKRMKSLLRNDLRISYAGRTFEIESFINDDERNVTFTLVTKEVGIK

SEQ ID NO: 5661 - protein, 107 aa, Bacillus licheniformis
MATLKDIGVPVRFITYSGDEDTYILFYVYTVSDALSMEDEETFANHYVQISIFTKDPTKYSELEKEVKSRLKRAGFFRSNEQDLYENETELFHKVLRYGTTLNTEEE

SEQ ID NO: 5662 - protein, 193 aa, Bacillus licheniformis
MAKGVRVGLKNIHFAKILTEDENGVTYDTPVKIGNAIEASITPNTNSETLYADDGPSEVESSLGETEVEIGIDQLSTTAQALLLGHTILSDGVLEKKETDIAPYGALLFESATTGGKSKLYALYKGRFQPQEESFATKGDSPEFQTDSISGVFVRRDHDKVWQRSVFTGDEGVKAEVIENWFKKVYEPTTSTP

SEQ ID NO: 5663 - protein, 104 aa, Bacillus licheniformis
MKTGLRKFTNQQLLLPDAPQNLRYDSTTDSITVEWDPVDGATSYNVYRGADKKFAENVTQPKYVTTGMSPDTKLTINVTAANESGESPMSEIVTQTKMKIETES

SEQ ID NO: 5664 - protein, 111 aa, Bacillus licheniformis
MQITLMIDGEEKVFQAPFVKGRMLREAIKLSKSSNFDDLDVEDLDALVGYVVRVYDEQFDIDQFYDGISSEKLIPTITETIQQVVGTVAVPNEQVGENKETEAQAIGEVKN

SEQ ID NO: 5665 - protein, 1766 aa, Bacillus licheniformis
MATESVGSIRVSLGLDNIDFSRGLQDVNRKLKVLNSEFKAAMAGAGRFDNSLDSLRNKTDILNRTLQTQKAKLNELKRQYEESVRTTGRYSAQSEKLLAQYNRTVAAVRKTEDQLDLLNRKMREQSNGFSQLGAKISASIKTIDTKLRVLDSSFEAASAGVRDFGSTTEQLRQKSEHLTQSISLQEQRLKNIRRLYLEAKRAKGEDAQATQELRVQMNQATAQLRTTQAELAATNRQIQSNTGRWNELGNRMGEVGDRMRDVGGRMQSAGSEIAMSFGVATAALGGGLAVSTKKAMDFEQQMSSVKAVMNPAEANQYSAALTELAIKLGADTKYSALEAAQGMEELVKAGVSTKDILNGALKGALSLATAGELELADAAEIASTALNAFKDDNISVAQAADILAGAANSSATTVGEMRYGLQMTSAVAAGMGLSFKDTATTLALFAQNGLKGSDAGTSMKTMLSRLVPMTKAQYETMHDLGLVTLDTSEAFKRMADKGFKPASKNIGDIYEALNKYVEKTTGAKQGTEKFEKAFDKATRSLGIMDNKFFDANGNIRSMTEISGELSKALDGLSAKDKQEALYNIFGSDAIRGALILGKEGSKGFDKMAAAMDKIKADNVAAEKMNNLKGKIEELSGAVETAQISFGNALTPAISALVSVLQSATDWFNGLSKGMQSFVAISLAVTTVIMGIVAALGFLMLGVGQMISGLGTVSGLLKGLIKSEKFIKVIGVAFGALTSPIGLTVLGITAVGAALVIAYKKSEKFRNFVNGAFESVRNVTVTAFSSISAVVGDTFNFIQKASVAGWERFSDGVSVIVPAVRKRFANVVNSIGEFVSNIGSSIADRFGSGLADRTGSAVDLFIQNLRAAFSSVGGIISILAPTVTALGLAMAGVSGSIGFVITSLVSLAGFLFRLYQTNEEFRASVQNAWSQIMSVIGNVVVAIQPIINQFIGYFSDIAAELAPEFAKTGEVIMSSISSLGPTFTELGNAFGELWTTLGQSFSEIAVQIAPVIQELGVTFAAFLPQVVTLVGQLIQTWASFQVQFAQLIMQVASVLLPMLAQAFTSLLPLILQIVSSVLPIVLQLIQSLVPVVTTIATTLLPILLQAFQSIFPPVLAIIQSVVPIVANLLTSVAQILSQLAVTLLPLILQVVQAVFPVVTSIIQIAMQVAVTVLQLVATIIRTVLIPAIQFVLKIVQVVFPVVVSVIQNALNIVINVVKFFTALLKGNWSAVWNAILGILKSIWNIITAVIRGAVNVVLTLFSGLVNGAVSAWNFLKDRTVGLFKSIGKFAADTFHNMIEGAKALPGEIGDGIKNMAGRALSGVKSLGNTMIGGLEGIINGLTQKGINKLLDTFGVDKKLRIPKLEIPRFAKGTPAGGHKGGLAILGDGGGPELFRTPSGFTGLSPGTDTLFNLPKGTQVLPHKETREVLSSGIPAFRKGTKNKSFFDSAIDVGKSAVDAGKAAVNSVKDFAFDAWEYVSNPSKLIAKTIESLGLKLPDISGAFGTIAKGAFGKVKDSAVSFMKKKLADFGGAFGSGDKASGNVKQWIRAAMAKTNSPASWFAPLVTIAMKESGGRTGPSTINRWDSNWRRGTPSMGLMQTIKPTFDAYKLPGMGDIMNPVHNAVAAIRYIKSRYGSPFNTPGIRSMEKGGPYKGYKIGDIVTQKQLAWIAEEGPEAIIPLQNHRQRAQQLWTAAGREIGMDPSGGSNEEELALLRGQNALLRQTNTLLTGILRKDPSVVVDTAALTDSVEKGQAQNIGFNKLLWGDR

SEQ ID NO: 5666 - protein, 273 aa, Bacillus licheniformis
MAYLTIIKNGETIDHRKYGLKLLSFRKESLTHRTNFEEIGGRHGAIDTGTTFGERKLKATFLMQGVDHLDYQLMIDEVYALFACEDSIELIDSRQPGKVWTVKPSSTFEPDDLNPRSGKFEIEFTSPLPFASSYGSTLDPFTFGEEVWQIGQGLIPSDSLVYRHRTTRFSIFNAGNVEVDPCLEMPLNIVYKGASSNFSIKNKTTGQTISYNGTSKSTDSIKLEGLRHLKNGISIYGNTNRGYVSLKPGWNDFELTGTSGSFEITFDFFFFYK

SEQ ID NO: 5667 - protein, 508 aa, Bacillus licheniformis
MKTIAIRDVTGIMEPLPGFSVVRTDGSDGQRSIKLNGYKTTNNQYGYQFVKNENTVVYDDEEYIIKTHRERTYRKGVGVEATAIHRIFDDLRNNYIYDEKTGTLRLDAMLSFALEGSGYTFEIDTTDLPASVRVENFGWNNSLALFRDILEKFGAEFDYKGKKIYVAKKFGIQRDEPFLRYRFNVKDPEKEIDTSSFATYIRGYGKKDDKGNYLFAEYTSPLAKIYGIKHADPVKDERYTDKDSLLAAMKKQLNDNIDISLTFTAIELESMGLRDIKKGDYVWCVIEPFDLNVQLRAVSREDYSDETKSPTFTFGTITKKASDIIASFNTTKKAVDKVIDTSTGKIKDSAIDTTGLTTKSEFQSHVDNKIVHITAEERAAWNAASNSIGDLTFITWSTPTLKNGWIQYTANTESYPIQYGKDAIGTVNIRGAVSSGVVGSSTPVFTLPAGFRPPFPHLFIGVSSVATDGTPQYFRGIIKTNGDVCIENISNKDTPNQFIGIYTQFKAI

SEQ ID NO: 5668 - protein, 659 aa, Bacillus licheniformis
MGKFYYKKATTSGFDRQYIKDQNQNLDDIGKDIREVDTKINDHKKAKNAHTSEQISHESGLNVGQEIEVTKARFRNLVLNVDGTNVKEVVDARVGRDGTIYPTLRDRLDADGQTVDDIKDDLITRISFKNALSYGADPTGKTPSADAIQSALDEIHSEGGGWLVIPGGTYLIDKRMIIYENTRVTMAADCVLLRGWSGGFFANGKPTDNFSGYSGRGNIVIEGGMLDGNYLKIETYKTNAMDSVIIGHAKNIVIDNVTFKDVITDHAIDANGCNGLRITNCRFTGFIDTSGTRPFSEAIQLGEFTKGGVNIFGAFDSTPNTNVYIAHNYFGKSDLLGGWGCAVGNHYAVYDVFQTNITIFDNTIEDCGFAGIRTFKWGEVKIINNVFRRNRECVRISQVSGGIESSKNASGVQMNRPQNAQNILIQGNDFYEYTVCGVVTYGQIYNKEAAWSDGIRIFGNYFKLREKDIGSYGNEQAIQIIYGRNVFISDNRIFGGRRGIWLEGCFNTFISNNYISCVDTEAVYVAKSRDTSSTITKSTHLSIDGNEINTIGRNGIYVQNCDNFDVRNNNIFNTNIEQGSKDRGGVFVEKAYDGRIEGNRIRGVEKIFAILVQSTATEVNVFNTKGTGRVIVQGDSNLNGYYGTTQNDYIRKISTKSSS

SEQ ID NO: 5669 - protein, 516 aa, Bacillus licheniformis
MIYKDSEVHFNISSQIKRSVSANIQFSTQDINTAKLTISLTKDGVPLPISQATHGKLFMRFADGSKFYVNTEVQDALGGVIFYVLTPDQVTHYGTVQAELYVNYDNGQKLSVHKFSFEIDRALVDQDIAPVAEYYVDDFESLKAVIQEMADDAEQVLAELQKKFENLDNIETKEGAQEKADVAEAGAKAYTDKHAAKIDNPHKVTKAQVGLSNVDNVKQASKSDFDNHVGNTANPHAVTKAQVGLSDVDNVKQASKAEFDTHNSDNTRHITADERTKWDGGQLRKLTDDSGKRTQVADGADLLTLSTGFYFATGNAVQNNPTTNDSAQFTYDVIESDQGRKTIYAWRTTDNTLWHATVIPDTAFKGWKRVITDDDFRKKTFVDTYDFDNSAFTATEGVVTKIKFGAARADDQSEYDQTKSEITLKNSGLYLVRLYISATAIPSNSDIGFICYVNDAQYQTMGYWYPSKSTQTNVVFLQQKFNSGDKVTFHIFPKVTGSTPSSVSVKSAFLTMSQIR

SEQ ID NO: 5670 - protein, 98 aa, Bacillus licheniformis
MNLALAVKYLFPDAIIGEDFIIRDDGDGRGQYIETWRISAPQPSEKELQEAWENYLENPVTDDPQLSYTSQQLLKLGREMSSLKLEILALKGEMTNGS

SEQ ID NO: 5671 - protein, 58 aa, Bacillus licheniformis
MDLNFWVYALYYNWADTPMVKQALQYNDVTIEELRDGVDQGYVTPEQFQEITGEKYIA

SEQ ID NO: 5672 - protein, 275 aa, Bacillus licheniformis
MRKLFFISLVIMLFLSVNVGCSNVDATTSKSIEYSPLIIAHRGASELEPEHTIRSYSRAIKDGTDFIEIDLRVTKDGKLVAFHDEDVSRTTDGKGDIEDLSLNHVKELRTEKDQQVLTLEEIIKKYGDSTKYYIETREDSKGRLVMEKKLIDILNRYNLLENNQVIIQSFSAKSLKQVRKLNKEVPIVQLVQTWDAEKLSERIKDYKKYAYAIGISSQTLSDKEVKMIHDENMEVHTFFRVELEKEETKRMIELKVDGMFANNPAYLNKLLDGSK

SEQ ID NO: 5673 - protein, 67 aa, Bacillus licheniformis
MGELDVIKYFLTQGPFAVLFTWLLIYVMKSNRERESRLQDLLDKFSDKYDVIIDKLDRLEEKFRGRE

SEQ ID NO: 5674 - protein, 311 aa, Bacillus licheniformis
MAISVKKNLVASSKYSVKCPYSMDAKYITFHNTANDASAANEIAYMIRNNNQVSYHFAVDDKEVVQGIPTNRNAWHCGDENGPGNRSSIGVEVCYSKSGGAKYKAAEKLAIKFIAQLLTERGWGVDRVKKHQDWSGKYCPHRVLDEGRWGAVKAAIAAELKALGGKSSSPAKSAPKASGKTYTVKKGDTLSEIAVKTGVSVAKLQSYNGIKNPNKIMVGQVLKLTGSVSSKPSSSGKKYVYLPASADSWRIYPTNKAPVKGNECGFLRPKKFGGLKYEILANPQTDVYTIKTDQFGKVNIYAAKSTGATIK

SEQ ID NO: 5675 - protein, 85 aa, Bacillus licheniformis
MEEVLLFATVLAPILTALVQLVKKTINMPTNVVPAVSFVLGIALGAVAYPFTDLELVLRLWAGGFAGLAATGLFEIGAKREGTTK

SEQ ID NO: 5676 - protein, 118 aa, Bacillus licheniformis
MKKILLSLLLIPLLALTACNSVDSSKNTEDEKIADTKKEETFEATEKNIKLLVADELKEKGIEDTDKLDSFEIFDDVNKDNKPIKTVLITLNGNDNLTKNMIKKSMLKEGEKTVPSDI

SEQ ID NO: 5677 - protein, 67 aa, Bacillus licheniformis
MRLRLKELLEEHGYEQKEIAEELELSTRAVSELCSGKTKRYPKETLEKIIDKFNITDMNELFEVHED

SEQ ID NO: 5678 - protein, 272 aa, Bacillus licheniformis
MHYLAEHQTFASTAELNAAVYEHIKRNTYELNDTDRLTLKTIARYAVKFAGAAHLKAETLADLIGKSVKTARRAVNKLASLSIIQKVATTRKINGGHGANIIVILPVGSRVEDMQLSEDDQSTMTTRGDAEKPSEPTDESPKTTNEPSDSINLSKNHVIDTVPACGLKNALPSEIYSAMARYFEADEIYKYYGILLRAKASVDPTLILEEHPQPFVEAWHAAILKRKQQKIRRFDDYLYASFRQAAWTVKARENRVKNVGLLAEFETFLQAE

SEQ ID NO: 5679 - protein, 109 aa, Bacillus licheniformis
MTLRDRGTMKWTSIFLPEHIASLRKLKSEIDHAYERKPSIDPEQWSDFESKIQYAYRTGQDCEIRYWRNWVAERVSGVIESVDPVGGTLRIEGVDIPFREIVWVALEDV

SEQ ID NO: 5680 - protein, 381 aa, Bacillus licheniformis
MTVIKKDDKTGKYYFVYSGGVHPITGARIQKRRQGMSSLREAKEVLKQVIIEVDKEKNSHNPNKSVFSTFAEKWFESKKVRLRSSTIVNYREQLDYNILPYLGTFKIKDITEEVLQHYINRLHNERKLAPATIRTAFGVVAEVLKKASRKGAFDLAILDDVNLPPENRISKVWNESNVQAFLDARNRIVSLTRYFIGMVLSVITGMRMGEVLGLRWSDIDFEKGYLTIRQTLAKIDDEGNYGLVPEVKTAAGFRTVHLPKFFIEYLIEHKKMVQREKEILGEDYIDYDLVVCTKHGKWVHPNNYRRAFTRLIAQLELPKIPPKNLRHTHATYLISIGISPKIVQERLGHAHIKTTLGTYSHVLPSMQAELVGKLDDLVAKV

SEQ ID NO: 5681 - protein, 65 aa, Bacillus licheniformis
MNIIMNDLIELMDPRYIEVWGKFTPRGGISIDPYTNYGKPGTKYEKMAEYRMMNHDLYPETIDNR

SEQ ID NO: 5682 - protein, 135 aa, Bacillus licheniformis
MKQLIPSSKVGVKIHEWYKMIREFSVPDAEALKEEVEKEINQMEEDQDLLLYYQLMCFRHQLMLEYLEPTNKRKQGQSINKLLAQIEEPRRDLNGLLSYYSFFFRGMYEFEKKQYIKAIEFYRNAEKQLALITML

SEQ ID NO: 5683 - protein, 263 aa, Bacillus licheniformis
MRALKQLVRFGWEQSLSCVFPVVIFASLAVTQIIPLPFLPRYDLLLIICVLMQWWMVRSGLETRDELKVITLFHIIGLALELFKVQMGSWSYPEEGYSKIFGVPLYSGFMYASVASYLCQAWRRLKVELVKWPPFYVVVPLAAAIYLNFFLHHFWIDVRFWLSGLVIIVFWKSWVIYEVNGIRYRMPLALSFVLIGFFIWIAENIATFFGAWTYPNQTSTWSLVHVGKVSSWLLLVIVSFLIVATLKQVKGKDSTRVDAGQFL

SEQ ID NO: 5684 - protein, 73 aa, Bacillus licheniformis
MAIIINIDVMLAKRKMSVTELSEKVGITMANLSILKNGKAKAIRLSTLEAICKALECQPGDILEYRSDEDTQD

SEQ ID NO: 5685 - protein, 160 aa, Bacillus licheniformis
MKRGSTLFLKIAVILIGIPVLALCIFFVPEIANFAAELYPGISYLKYLVYADLYAAAIPFYFALYQAFKLLSYIDQNKAFSELSVRALKNIKYCAITISILFAAGMPLFYLIAEMDDAPGIILIGLVLIFASMVIAVFAAVLQRLLQEAIDIKSENDLTV

SEQ ID NO: 5686 - protein, 81 aa, Bacillus licheniformis
MLKTGMRVTAATKLEGIKTTLRPKFKIDDIQKEMNSVYSSLLYSFEGKAQQALAQRISQSAQQLIATEKDGESFVNGFKTR

SEQ ID NO: 5687 - protein, 109 aa, Bacillus licheniformis
MRTMKREAENAYQEHDAEINDLKHDTYRQVGHGLYDKLTLEDVNNTLKNLAQSFDKKGNPLFYDVHAEKAYIASLKDTISDLEDISGYLAQIAKDFKSKDKMLANWLKL

SEQ ID NO: 5688 - protein, 371 aa, Bacillus licheniformis
MYLNKKSDIPKLTDKEYYFLSQNTYSTDKMKEAFKERTPIESKSNKAFFVDKIKRDSDTGLDAYVFVQAKKKDGKWVKPNAPENVVVAFAGTNPKEQFFQDVIDADGGNVVMGLDPKKKSQYIIEKDAKDTSKTIGKYNATPSQDAMLSTGKYKLITKTSQIGQADDLVREVKQKYKGTSTVISTTGHSLGGAEAEYSAVNNDIYAVAFNNPSVVKLHSEEKQKEIRSGKYDSSVKAIVNPDDMTGSGWWNEYERHAGRTIYTKDPSTSRVERQIRLDPKYSGGIFGTVFNVAVDYIATTAMGMPDTHGLNKGNFTFDENGNVQNIEGDELVYDKNLKAMLPPEVASGSGAIKVTPEVAKQLAQKVNACGR

SEQ ID NO: 5689 - protein, 114 aa, Bacillus licheniformis
MKKYIIILLALVIITSGGIFMKQQNNNREKEELYNLAKERMTDFIKTNYKDIKSIDYYDDYEVNPMGGIDIKGYLNDDKKKKIWGIYDKANDEVGSFTVDAERKPEYKDKICDY

SEQ ID NO: 5690 - protein, 284 aa, Bacillus licheniformis
MKYKKAAALGIGLLLFIGGCQKSGEAEISVQDYTGQDFHIHSKGYQKETAEIAEAHRDEVEKTVKDYFLDQYRTKVKVHNIVGGHGFVTVYAESVGNLHFYTSAKIEIDLDKKEVQADAISSSEWDVKDSITSAIYALAFEEEFAALDYYLEKLAEEEPVVGKTQAAVDNTSGMGYQTPYYAVSLNADWKDDLYSAYLENPKRSKKDWQEKLEDEEITPKSCDINIRLYMNKPNTRPDERIYNQVVQDIEDMEELAPGTYTIYLSDNRINKNLGYNSRKSTLGR

SEQ ID NO: 5691 - protein, 62 aa, Bacillus licheniformis
MKIAKVGNVIEFKNGLTGIVEKVNENSVIVDVTIMENYRDLELDSLTVVNHKNYKIIKDSLH

SEQ ID NO: 5692 - protein, 64 aa, Bacillus licheniformis
MTEQNAIDQIEQLRSGSIHELRVKKEDFLSFRAILTKQEDFKHFRGIAQHGGDIIFQYMKEARS

SEQ ID NO: 5693 - protein, 203 aa, Bacillus licheniformis
MKSKFAALAAFLICMLPAARIEHAQAVMLFSKKDKQEMERLMESLKQEENPAFSQLTDEKSFIEAAHLSAEEEEEIEEAEEETTDLTHKEKDLLSRLVHAEAKGESFEGKVAVANVVLNRVKDSRFPDSVKSVIYQRNAFEPVLNGSIEKKADRESVEAVEEAVDQNKKETEALFFYNPDIASDDWIKTRKVVKRIGNHVFAI

SEQ ID NO: 5694 - protein, 446 aa, Bacillus licheniformis
MNRFVKGIVLLSLAAFFAECLEFVINMILARELGEHGMGLYMSVLPSIFLVVVIASLELPVSISKFIAESNPKLHESMLKHALRMTAVCTVFSTAAAVIILPFIPVFDSYHPLIRGLVIGMIPTVAFTSIARGYFMGVQQMGKIATANALKKIFQLIGLFLFFQWYSFELDTSLLISLFVLVASEVVVFVYLFSQFVLVRRAAQKGQQIHLRRNDVLKRLLTVSIPTTGLRVFHAVTNAVEPFLVKGTLLAAGVSRTSAIDQFGMLSGVAMTIGFFPAFIAHSLMVVMIPSISESYAYGQYERVIKRIKQAIFITLFYGIPSVMVMYHFAEPLTHLFFDSVKASFYLKMLWPYFLFHFFAMPFQACLIGMGLAKDAFYHNVWASVLSFLMMYVLGSMQTLQMTGIILAMNTGMILLTALHYVTICKELGVTLFLTNKSRSPRIESR

SEQ ID NO: 5695 - protein, 163 aa, Bacillus licheniformis
MRRISLIYPLILLFFTGLFVFQPQASAKQASPAVMQMNTVEGQRVVIPAEGQKTIVHFWTTWCPPCREELPRFQSYYESKQSGVKLVTVNLLNAEKNEQKVKQFIKANKLTFPIVFDKKGEMMKAYKVMTIPTTFFFNEKGELEKTFVGPITVEQMKEWAGKS

SEQ ID NO: 5696 - protein, 635 aa, Bacillus licheniformis
MQLEIGKQSQQNRHTLQFENWRQHGELIAALLSGLLILAGWLLSGNETLSVVLFILAFCIGGFAKAKEGIQETLSEKTLNVELLMIFAAVGSALIGYWAEGAVLIFIFSLSGALETYTLNKSKRDLTSLMKLEPEEAVLLEKEGTRTVAAADLQAGDLILVKPGERIAADGEIETGKTSIDESALTGESIPAEKTLGDAVFAGTVNLSGSLTVRVTKANEDSLFKKIIRLVESAQNSVSPSQAFIERFENIYVKGVLLAVGLLLFLPHFLLGWSWSETFYRAMVFMVVASPCALVASIMPAALSLISNGARNGLLVKGSVFLEKLGNSKIVALDKTGTITNGKPGVEDMLLAADIEERECLEAAAAIEKQSGHPLAKAIVEYAEAKGIKPAANVSIEETSGFGVQARYNGETWLIGKAGFVGEEAAGQFLTAAVQELAKQGKTIVFMKKGEEIAGCFALKDQIRPESKAVVEELNALCVQTAMLTGDQPETAAVIAREAGLKIVHSECLPDRKVEEAKKLHKTYRTLVMAGDRINDAPVLAAVDVGHPVRGGTDVALETADVVLMKNELTGLTKMIRLSRKMNTIIKQNVIFSLAVICLLICSNFLQILDLPLGVIGHEGSTLLVILNGLRLLKS

SEQ ID NO: 5697 - protein, 364 aa, Bacillus licheniformis
MERIEQISSWLKEKNISSAFIHSKENVFYLTGFYTEPHERLMGVFIFQDEEPFFVCPQMEAGQARAAGWAYEIIGYGDHQNPWELISSALQKRNGQCLKVAVEKETLALSRAEMLQAVTNGAELVSAEERLNQIRVIKDEKEISILREAAKLADYGVEAGAAALKEGIAEIDVVAKIEYELKKKGVQGMSFSTMVLFGEKSGQPHGNPGSRTLKPGDFVLFDLGVIIDGYCSDITRTLVYQNVSEKQKEIYNTVLQAETEALKMSKPGVRIGDLDLKARGIIEKAGYGDYFPHRLGHGLGISPHEYPSMSHNNDELLKQGMVYTIEPGIYVPEIGGVRIEDDVLVTADGAEALTKYPKELTVIS

SEQ ID NO: 5698 - protein, 241 aa, Bacillus licheniformis
MKKLGFVLFMSMFAFVSVVPAAEAKVIDHDKVQGFSEVTPVTVSQKAAKRFQPYLKVASGCVPFPAVDAQGNTSGGLEPTGAPEGHCSKSVGQVYSRSAWYNGVWAIMYAWYFPKDSPLPLKAFGHRHDWEGIVVWIDNPANQNPKVLSIAYSQHGKFQKTAPNNNIMEGDHPKIRYDAPQPPINHSLYVDSAKGGTQPLIGWEDLTPAARNALNTTDFGSANVPFNDHNFTNNLGKAWFR

SEQ ID NO: 5699 - protein, 323 aa, Bacillus licheniformis
MANIREIAEAAGVSITTVSRVLNGHPYVKEEKRQKVLETIERLEYARNMHAVHLSKGFSNMIGVVLPTISLPYFGELLEGIAEEAAKEGVHFSLYQTNYQLEKEIFALEQLKQRQVDGLIFCSKAMSDEALLDWRETGPFILCQDSGEQHFATVSIPHKEAFRLGLDFLIEKGHTKIAIGLARKNGMNSHFRLKAYKEALAAIGEPYREEWVFERSLTITDGQKLFSEWKGMEEKPTAVFVANDQVSAGIFLEAQRHQVDIPGSLAILSCDNQPISEVLGISTIEINIKEMGKRAFRLLQKRIGGAGPEKLTVPYKLIKRATV

SEQ ID NO: 5700 - protein, 281 aa, Bacillus licheniformis
MNRSFTVEKVLNNNVLIALHDDYREVVLIGKGIGFGKKRGDLIEHENYEKMFILENDKEQSQYKKLLTYVDEKMVDIANDVIYHIAQKIGQPLNEHIHVALTDHIAFAVKRLEKGFDMKNPFLLETESLYPKEYEVAKEAVDMINEKSDIQLPEGEIGFIALHIHSAMTNRPLSEVNQHSQLISRLVQVIEDSFQMQVNRESVNYLRLIRHLRFTIDRIKRDEPIQEPEKLMLLLKTEYPLCYNTAWKMIKILQQALKKPVHEAEAVYLTLHLYRLTNKIS

SEQ ID NO: 5701 - protein, 553 aa, Bacillus licheniformis
MFKSLFGVLQKIGRALMLPVAILPAAGILLALGNAMQNPQMTKVAPFLTNSTVQLVAKVMESSGDVVFTNLALLFAVGVAIGLANGDGVAGIAAIIGYLVMNVTMSAVLLQNGSIPSDAVERAQFFTQNHPEYTTMLGIPTLATGVFGGIIVGVLAAAMYNRFYTIELPQYLGFFAGKRFVPIITSICALLLGLVMLFIWPPIQGALNSFSTNLLAANEAVAALIFGMIERALIPFGLHHIFYSPFWYEFFSYTNQAGEIVRGDQRIFMAQIKDGVELTAGTFMTGKYPFMMFGLPAAALAIYHEAKPQNKKLVAGIMGSAALTSFLTGITEPIEFSFLFVAPILFAIHCVFAGLSFMMMDILNVKIGMTFSGGLIDYFLFGILPNRTAWWLVIPVGLVLAVIYYFGFRFAIRKFNLKTPGREDAAAEPADEGKEAAGDLPYQILEAMGDQENIKHLDACITRLRVTVNDQKKVDKERLKKLGASGVLEVGNNIQAIFGPRSDNLKSQMQDIMSGRTPRPEKATCEGRCRGIGELSNQEESSLVMSLSSKRIR

SEQ ID NO: 5702 - protein, 88 aa, Bacillus licheniformis
MAQKTFKVTADSGIHARPATVLVQTASKYDADINLEYNGKTVNLKSIMGVMSLGIAKGAEITISASGADENDALSALEETMKSEGLGE

SEQ ID NO: 5703 - protein, 572 aa, Bacillus licheniformis
MLELKGIGASAGIAIAKAYRLEEPDLTVEKKNISDSDAEVNRFEDAIERSKKELETIKNHALKELGEDKAEIFSAHLLVLSDPELLNPIKDKIKSDSVNAEFALKETADMFVTMFESMDNEYMKERAADIRDVTKRVTGHLLGVEIPNPSLISEEVIIVAEDLTPSDTAQLNRNFVKGFTTDIGGRTSHSAIMARSLEIPAVVGTKAATKGIQNGVTVIVDGINGDVIVDPSQETISEYEEKHQAFLAQKAEWAKLVNEPTVTSDGHHVELAANIGTPDDVKGVLENGGEAVGLYRTEFLYMGRDQLPTEEEQFDAYKTVLERMEGKSVVVRTLDIGGDKELPYLELPKEMNPFLGYRAIRLCLDEQEIFRTQLRALLRASTYGNLKIMFPMIATVNEFKAAKAILLEEKEKLKAEGQQVSDDIEVGMMVEIPSTAVIADQFAKEVDFFSIGTNDLIQYTMAADRMNERVSYLYQPYNPAILRLITLVIEAAHKEGKWVGMCGEMAGDEIAIPILLGLGLDEFSMSATSILPARTQISKLSKKETESFKEQILSMSTTEEVVQFVKETFNLA

SEQ ID NO: 5704 - protein, 77 aa, Bacillus licheniformis
MPRQPFKLGDEVYVIYRNPHAANVAHIKEAEVVDHPLHEGELALFMYDTYHAFAEDDAVFSSYEEAERLYRELFDGI

SEQ ID NO: 5705 - protein, 347 aa, Bacillus licheniformis
MCLFPMVKPFVPQLVYIEPRALEYPLGKELRDKFSNMGLEIRETTSHNQVRNIPGEGHLQKYRNAKSTLVIGVRKTLKFDSSKPSAEYAIPFATGCMGHCHYCYLQTTMGSKPYIRTYVNVEEILEQADQYIKERAPEDTRFEASCTSDIVGIDHLTHTLKRAIEHFGQTDHGKLRFVTKFHHVDHLLDAKHNGKTRFRFSVNAEYVIKSFEPGTSPLDKRIEAAVKVAEAGYPLGFIIAPIYIHDGWQEGYRVLLEKLDRALPQHARRDITFEMIQHRFTKPAKRVIEKNYPKTKLELDEEKRRYKWGRYGIGKYIYQKDEEAELRSALESYIDNYFPEAKIEYFT

SEQ ID NO: 5706 - protein, 222 aa, Bacillus licheniformis
MAIYKQFYVDNGTSYQQVDIRNYSKKDIPGLIALQRECFPPPFPEDLLWNEEQLHSHIERFPDGALCAVSEGRIIGSMTALMADFDPHHPHHSWDEVTDNGYIGTHQNDGNSLYVVDISVSPDYRKLGIGMRLMQSMYELTVFKGLKRLIGGGRIPHYHKSAEEMTPEQYVQAVLDGEKRDPVLSFLLHCGRSPVCVIPGYIEDEESLDYAVLMEWKNPFLT

SEQ ID NO: 5707 - protein, 655 aa, Bacillus licheniformis
MFKKLHVKIAGFVAVLLVLTVIVLQFSTTHLLKSMLEDEAKESTSSLLGSIKRNIELQLEHYEISLNRISDGEMAHSFLKDGDNKIIKIVNDELKQLKEKNEYVNLAYIGTKKKEMFTFPKTTFDDDYNPAERPWYTSAAKTPDKVVWTEPYKDAVSGDMTVTAAKAIVVNNKVEGVVSIDLSLNSLNKIIENQKMPYDGYAFILDQNGTMLAHPSKQGDDISNDKTYRDIPSSKDGIKVGKDTVIAYQTVGGTGWKVGTQFDTAKLMWVAQEMNKMVIIVSIIALAAAIILSYFVAKTITGPIKQLIAKTKAVAGGDLTVQTAAASKDEIGILTKDFNKMVEHMKEMIVQVRSSSGKVSDTTDQLSAVSEETVSASDEIAKAIEEVATGATEQAAEVENVNEQSERLSVKIKEIEHHADSIKKLSRTSEEASYTGIDALGQLLAKSNEANSETKKVEHMLFQLEEKTKNIEDVVTAISAISDQTNLLALNASIEAARAGESGRGFAVVAEEVRKLAEQSAVSSQHISETVKQIQMETKEAVSAMTEASKMNEVQNGMIHETGEALSKITAEMQALVNSIDHIYSEISDMSGEQQKMSDSIQSISAISQQSAAAAEEVSASANEQLTALESIAKSAEALSEANQELLNAINKFNV

SEQ ID NO: 5708 - protein, 264 aa, Bacillus licheniformis
MIIVDLKMNGKTALVAASSKGLGNAIAKAIAKEGANVMLSGRHEADLKKAAEELNGLGGGTVSYQVCDLADADGIKALVQKTADTFGTIDMLVNNVGGPKGGSLLDLTDDDWTSSFELHLLSYVRLIREAFPYLKKDGGRIVNIASSSVKQPIPGLLLSNTFRMGIVGLTKSIAEELAEHRILINTLAPGRIATDRVAELDRLKAEKTGLSEQQVKESYEKEIPLGSYGKPDDFAQYASFLLSECNTYMTGQTLLIDGGMVKAI

SEQ ID NO: 5709 - protein, 290 aa, Bacillus licheniformis
MKKTVGFIGLGVMGNSMASHILAAGYPVSAYTRTKHKADSLVEKGAEWKSSVKALAQSSDVIITMVGYPKDVEEVYFGSEGIIENAKKGSYLIDMTTSKPSLAKQIETAAKEKGLYALDAPVSGGDVGARNGTLAIMVGGERKAYDECYPLFSIMGENIQYQGPAGSGQHTKMCNQIAIAAGMIGVAEAMAYAEKSGLDPDNVLKSITTGAAGSWSLSNLAPRMLKGDFEPGFYVKHFVKDMGIALEEAELMGEKMPGLELAKSLYDTLVEKGEENSGTQSLYKLWTEYK

SEQ ID NO: 5710 - protein, 240 aa, Bacillus licheniformis
MKKAFLLSAAAAATLFTFSGVQHADAKEQQQVQVKTVHSINVTDLAGKLNIQNMNQLSKADQEKIQSLLHSYMKQATQQPKASAPKASAPKASKPAASKEQTSQQKQNTAPASSSVSAYEKEVVELTNAERKKQGLKPLTLDEKLSKVARTKSQDMKDNNYFDHNSPTYGSPFDMMKKFGITYRTAGENIAKGQKTPQEVVKAWMNSEGHRKNIMNPNFTHIGVGYVKDGNYWTQQFIGK

SEQ ID NO: 5711 - protein, 702 aa, Bacillus licheniformis
MTESQHDPAEIKKSRRSRLWRINLYFFAVFTLFAALIVKLGLVQIVNGEAYEQEASKTEAKIASYPAPRGKMYDRYGRVVVDNQSVPAITYTMMTSTKTEEKISTAKKLAELIDIDTSFLKERDLKDYWLARHPKKAAALLKDSEKTLKSDQTYKLQVDRVPAEEIKALEKDKDELKVAAIFRRFSGGYAYEPQIVKAMSPKTAGKNDAQLLDEKASKQMPANDLTYEEVSRVSEHLEELPGVDVIMDWTRKYPYEKTLYSIFGGVTTPEQGLIKDREDFYLTRGYARNDRVGKSYLEYQYEEYLNPKKAKVQYTENRSGKVISQETVDEGRRGYDLQLTFDMELQKKVEEAIEEELNKFRGSNYMLDRAFVVMMDPNNGDILSMAGKRIVDGKITDYAIGAFTTQYEMGSAVKGATVLAGYQDGMPHGQSYLDQELSFAGGVKKGSYRGNTIGWANEVRALEKSSNVYMFYVAMRMAGITYVPNGPLPANLEDLKKMRYYFNQFGLGVKTGIDLPQESAGMQTNPKIVGGLLLDEAIGQFDTYTPLQLAQYVSTIANGGYRLQPRVVKSIHQPESEKLGPVIEERSANVLNRINNSQSDIAIVKQGFKRVTQTGTAAGAFGSLDVSGKTGTAQTQYYGTNRNWWGTRTYNITFAGYYPSENPQVAFSVVVPNVDDKTKMNKNIAAKIVKAYVDLQKKYSKD

SEQ ID NO: 5712 - protein, 603 aa, Bacillus licheniformis
MEQKTKRFEQYKPHMNLQAVLSANGRFIYISANCKELLSYEQNELIGTYLKDYLHEDDLFLVESYFYNEHHLLPCTFRFVKKDYTMIWIEASIDFVTTHVGEKEREIVLKMKVFEDRPSKKSSSIKEEDAPEEASRLPAKEEFEAMIEGLPNPLCISVQGEIVYVNDAMVNLLGAEHKRQIIGKYSYDFIEKEYHDIVKNRIKRMQQGLDVGMIEQTWHKLDGTQIHLEVKAAPTIYQNQKAELLLLIDISSRKKFQTILQKSRERYQLLIQNSIDTIAVIHKGRWVFMNESGIRLFEAKTYEDLIGKDIYEHLHPCDHEDVKARLKRITDRQSESEIIKQTWYTFEKRLIYTEMVCIPTTFFGETAVQVILRDISERKQTEELMVRSEKLSIAGQLAAGIAHEIRNPLTAIKGFLQLMKPTMEENEHYFNIIFSELSRIELILSELLMLAKPQQNALKEKLDLIRLIREVTALLETQANLNGILINTILTDDKIYIKGDQNQLKQVFINLIKNAVESMPNGGTVHLTVRETDDSVVVEVEDEGEGIPEHVLKRIGEPFLTTKEKGTGLGLMVTFNIIENHNGTIEVDSKAEKGTTFKILFPK

SEQ ID NO: 5713 - protein, 389 aa, Bacillus licheniformis
MEHLLNPNVKEIEISGIRKFSNLVSQYENVISLTIGQPDFFTPHHVKQAAKKAIDENQTSYTHNAGYPELRQAVQLYMKKKADLNYEAESEIIVTTGASQAIDSAFRTILSPGDEVILPGPVYPGYEPIIKMCGASPLIIDTTSHGFKLTAKLIEEALTPKTKCVVLPYPSNPTGMTLSEEELKDIASLLKGRNVFVLSDEIYSELTFDRPHHSIATVLRDQTIVIGGLSKSHSMTGWRIGFLFAPKEIAKHILKVHQYNVSCASSISQKAALEAVTNGFDDALIMREQYKKRLDYVYDRLVTMGLDVIKPSGAFYIFPSIKSFGMSSFDFCMSLLEEEGLAIVPGSSFSEYGEGYVRISYAYSPDTLREGLDRLESFVFNKRQSIQTT

SEQ ID NO: 5714 - protein, 51 aa, Bacillus licheniformis
MGTIVAIKNHEMTILEEVSRAVYTEMLKEASDSEEQIYISWKEDFDSDYGY

SEQ ID NO: 5715 - protein, 174 aa, Bacillus licheniformis
MELELDKHETAPERSEYAGIGARFVASLLDGLILGIPAYIFTYVLTATLMLGNSDIMLMMETDPEYLSDQEVFTFIISMFKTVAIVGSITFIVYFLYYTLMESSKWQGTLGKKIMNVQVAKAEGGRISFGRAAGRFLAKSFLSPILMIGYIMAFFTERRQALHDMLAGTIVVKK

SEQ ID NO: 5716 - protein, 417 aa, Bacillus licheniformis
MTLPILSWALYDFANTIFSSNIVTIFFPFYLQEAVGENASMNQVASTFISYSNAAASFLLVIFTPLFGVLIDRTGRKKKYIGLFTMICVSCTILMGVFAGASFQKDIYGLPLSLILVVIMFVTAKFFYHSSLVFYDTILADLGTKEEIPLLSGFGIAIGYIGTLAGLTVYLLVGNQDFHRAFIPSALLFLFFSLPYLLFTKEKRKPEPKEKKSFFSGYWEIVQTFKDIRLYKPVFLFMIAYFFLNDALATAIAMMAVYSKTVIGFTTGQFVLLYLVSTVSSIIGSFLLGFVTKRIGAKHAVSLVAAIMITALTIGACTTSTLLFWIAGSLFGISLGGTWVASRTLIIELTPEHKRGEFFGLFALSGKISSIFGPVLYGSITLLFRDLGNMASRMAFGSLVLLAAIGLIIHQNVKAKA

SEQ ID NO: 5717 - protein, 305 aa, Bacillus licheniformis
MSSNQQEILLSSGTNELEIVKFEVGLNIFGINVMKVREIIQPVEITKVPHSHKHMEGMITLRGEILPVIDLFSFFGVEHGDDEHQEKYIVTEFNKRKIVFHTGAVSQIHRVSWEEIEKPTALNQGMDRHLTGIIKLDGTMIFLPDYEKIIFDLESESGMDPYQMKNEKFDQRRTDKKLIIVEDSPLLLRLLVEKLNEAGYNNIVSFENGKDAYEHALQLMEDGTALHEKVDLMITDIEMPQMDGHRLTKLLKDNPLSTELPILIFSSLITDDLRHKGEQVGADEQISKPELNELIEKLDKYIFKN

SEQ ID NO: 5718 - protein, 153 aa, Bacillus licheniformis
MDDHNHTKELKPTVENLSKAIYTVNRHAKTATNPKYLYLLKKKALQKLLNEGKGKKVGLHFSKNPRFSQQQSDVLISLGDYFFHMPPTKEDFANLPHLGTLNHSYRNPKAHMSLNIAKQLLQNYTGIKEKPLVTNRKRPASKPVFKKLGESYF

SEQ ID NO: 5719 - protein, 433 aa, Bacillus licheniformis
MDLFKNRNFVRLFFAAFASQMGTTVGNMAFAFFLLDRFSSQPAYTTIAELMYSLPTVFVFFIVGVVADRFDRKKVAENCDWIRAGLTVVLFFVLYLQIIPLVFLVLFIRSAVTKFFYPAEASLVQAILRKDQYAKAAGLNQMLFSLFLLFGVGIGAFMYKTIGLHGAIALDFVSFIVSGFLIRSCDIPLAARKPNGNKGWKNMTVKDSMRDFKEGIVYILKNKLLASLVFGYFIFGLVSGGLSVLPMFKMKYELSPDSYEWHTSLFTIVLGIGLLTGIAVAALLEKKVKPAYMMSVPIFIAGAFIILLGSTDQLPVYYSAAFLAGICIGPINTALGGWIPKIVHPRLMGRVSGWTDPLTMLAQSSALGMIAVLFPGIIADVDYIYYGLAGIILLAALYYFIALLKLSAESAEIDVQAALKRQKNTIAKMNSVL

SEQ ID NO: 5720 - protein, 165 aa, Bacillus licheniformis
MLMYQVKPGETLESIAADFRTTRQALLQANPGLNGGQVSAGQSIIIPGIRNPDTIPYRIAVSLNGRTLRLYERDRLVKTYPIAVGKILTQTPRGEFVIVNRQPNPGGPFGAYWLSLSKQHYGIHGTNNPSSIGKAVSRGCIRMHNRDVLELASIVPNGTRVSITP

SEQ ID NO: 5721 - protein, 275 aa, Bacillus licheniformis
MKNPSRRQFLKGFLGLAAAGLFTAAGGLGYARYLEPHMLETNFIPIRHRLIPKGFDQFRIVQFSDTHLSEYFTADELSNVVSQVNALSPDLIVFSGDLIDKPHRYREHERAVSALKKLSAPYGKLAIFGNHDHGGYGTKVYQTLMASAGFRVLRNDLLKLELIDGSVIEIASLDDLMLGRPDYEGILSKLSKKAFSILLVHEPDAALTANQYPVNLQISGHTHARTNSDSCIRSFDYASVRRRLYARNVCNSRNENLCHLRNRHEQAAAPLSVKA

SEQ ID NO: 5722 - protein, 254 aa, Bacillus licheniformis
MDRKVVIVTGGSSGMGKAIAKKQAEEGWNVMITGRTQETLEAAKEEIETFAGQVAVCRMDVRSVEDVEQMITEAAGRFGTIDALVNNAAGNFICPAEKLSVNGWKAVIDIVLNGTFYCSQAAGRYWIKEKKRGQILNMVATYAWGAGAGVVHSAAAKAGVLSLTRTLAVEWGSAYGIRCNAIAPGPIERTGGAEKLFESEEAAHATIKSVPLKRLGTPEEIAGLAAFLLSEQAGYVNGECVTMDGGQWLNPRPF

SEQ ID NO: 5723 - protein, 406 aa, Bacillus licheniformis
MLDPLDILTNIEDVIPYYQPIFSAEEQKVIGYEVLGRIKVETEVKSLGPFFSDPTIPEEYKKEVDLKVIRQALDHFLDSGRDLLIFVNQDANVLMMDHGESFLDLLMEYQDKGLELSRFVIEITEQKFEGDIEQLHHLLTYYRTYGIKVAVDNIGKESSNLDRIALLSPDLLKIDLQPLKLSSPSPSYEYVLYSISLLARKIGAALLYEDIEASFQLQYAWRNGGRYFQGQYLELPKDKFIERDVLKDRLQAEFHQFITHEKKKLTILYDHSEQFYKRVHQLVTSLKKTAQSDDEFLFNLGKELTDCSFRIYMCDEDGIQLTKNVFKHDGAWIFQPEYIGKNWSWRPYFLENIMRMRTMRKGFFSDLYSDIETGEMIRTFSYPMDEELYLFIDLSYSYLYEQDGLI

SEQ ID NO: 5724 - protein, 208 aa, Bacillus licheniformis
MKNVWSSLLCALLAAALVFFCADFAKAGEKPTRASLFETLQSVSDVHFQLTEKERTKTDMISLLEPYMEHAMAVKYVEANAFPEQAGWIFYGTDAPEVAIPFFSYGGDTKVAGKDGSYTVYEFVGDQNDGPVSYQKNYQTVTLKNTGGSFKVTDIGQSDTKPAGEEIMSKQPDEKETSSNFADKGEGDQAAFPLFATDVNWTLAGIFS

SEQ ID NO: 5725 - protein, 80 aa, Bacillus licheniformis
MSQLMGIITRLQSLQETAEAAGEPTQRNFEVNGEKICSVKYFEKNQTFELTVYQKGDKPTTFPFDNIDMISIEIFELLQQ

SEQ ID NO: 5726 - protein, 172 aa, Bacillus licheniformis
MADSFLFYNLSEDQMTFPEVIGRLKSFIRQDPRASYLLSVGTDSQIHQNCTKFITAIHLHRKGKGAWGCLKNTVVNRPIHSLREKISLETAYSQEIAAYLLNDYFNEIMDLLLPFTDEGADLTLEVHLDIGKKGMTKDLIQEMTGRITSMGICAKIKPDSYTASSYANRYTK

SEQ ID NO: 5727 - protein, 59 aa, Bacillus licheniformis
MERFSEEERKLLLNVLLDHEYAVELLSSEINDIETGTKNVDSLTYKKLVTLYDRVRSEN

SEQ ID NO: 5728 - protein, 147 aa, Bacillus licheniformis
MISLQSDELLETTVGQFMIDADKVAHVQVGNNLEHALLVLTKTGYTAIPVLDASFRLHGLIGTNMIMDKIFGLERIEFEKLDKIHVEEVMLTDIPRLKIDDPILKGFGLVINNAFVCVENEEQVFEGIFTRRVVLKQLNKHLRTLNK

SEQ ID NO: 5729 - protein, 291 aa, Bacillus licheniformis
MQLQELHMLVVLAEELNMRKAAERLFVSQPALSQRLQTIEKSWGTKIFLRSQKGLTVTSAGEKIIQFAKDVTLEQEKVRENIDELEGEIHGTLKLAAASIIGQHWLPNVLKTYVKQYPNVKISLVTGWSSEMLKSLYEDHVHIGIIRGNPEWKGPKHYLMRDELYLVDTEIRNIEDIAKTERPFIQFKSDSTYYQEIQHWWHQKFKTSPKQTIIVDQIETCKQMAFHGIGYAILPSVTLHGSGSHVHQIPLLDAKGKAIGRDTWLLGYEPAFQLKQVQAFVEVVKECTAME

SEQ ID NO: 5730 - protein, 159 aa, Bacillus licheniformis
MSKALIAYASMSGNTEDIAMIIKDTLREYGFDVTIQEMDDVDTDSLAEYDLLLIGTYTWGDGDLPYEAESFYEEVSSLDLKGKKAACFGSGDYAYPRFCEAVNTFYTMLERTGADLYQETLKIELAPETDEDAECCKEFAEGFIRWAEQQKRRAEIHVS

SEQ ID NO: 5731 - protein, 297 aa, Bacillus licheniformis
MFHKGATAVASAKHSGYFVAVKREGIFHYSLEQGWKRLFQLKSKICSITYIGDYLFGAGERGTIIRSSDQGATWSISSFPTNATIWSITGRTDGFVCAHGKHCIYISDDFGVSWKVVKPFSGLSHPPVIRSLCLHEERLYIGTQIHEVHGGVWAYDLASESAFMIKKETGRMTASMIAFEGEWLVCAMGSKKGNHGAVDLVNIHTNDEIQIRRGLVENEESFLDVSEDNGIIYVTSAQDRDGFSRIYQLDFFERELKWFDTIKGHGFRVANQKENFFCAGLYECKFVRPYEQPAAAH

SEQ ID NO: 5732 - protein, 150 aa, Bacillus licheniformis
MGKVLLVYASMSGNTEAMADLIEKGLLEGGAEVDRHEAMDVDAALFNDYQHMIFGAYTWGDGELPDEFLDIYDDMEGMDFIGKTFAVFGSGDTSYEHFCGAVDILEDKIKELGGNVVLPSVKIEMNPEDEEEGMLLQFGRDFAKKCEVPA

SEQ ID NO: 5733 - protein, 236 aa, Bacillus licheniformis
MKMMDANEIISFIQNSKKSTPVKVYVKGDLEGIDFGASAKPFITGNTGVVFGEWAEIQAALEANKGKIEDYVIENDRRNSAIPTLDLKNIKARIEPGAIIRDQVEIGDNAVIMMGASINIGSVIGEGTMIDMNVVLGGRATVGKNCHIGAGSVLAGVIEPPSAKPVVIEDDVVIGANAVVLEGVTVGKGAVVAAGAIVVEDVEPYTVVAGTPAKKIKDIDEKTKGKTEIKQELRQL

SEQ ID NO: 5734 - protein, 374 aa, Bacillus licheniformis
MKLDELAAIRRDLHQIPELGFQEYKTQAYLLNHLAKHPEGRIEIEKWRTGLFVKVKGTAPEKILAYRADMDGLSIREDTGYSFSSVHQDRMHACGHDFHMTIALGIIDHFVRHPVKQDLLFLFQPAEEGPGGAEPMLESDLFKKWEPSMITALHIAPELPVGTIGTKSGLLFANTSELVIELEGKGGHAAYPHLAEDMVVAASSLVTQMQSIVARNVDPLDSAVITIGTITGGSAQNIIAQEARLEGTIRTLSPASMEQVKKRIEAMVRGLETAYQCSGKVSYPAAYYQVCNSSDLVEDFMQFVSENGLAEVVRSKEAMTGEDFGYMLKKYPGFMFWLGVDSPYGLHHAKLQPKEEALETAVRVMTAYFSSKAN

SEQ ID NO: 5735 - protein, 81 aa, Bacillus licheniformis
MSKKIGIEQSLSDVEAALKEKGYEVVTMKTEDDAKGCDCCVVTGLDTDMLGISDTMTGASVIQATGLTADEICQQVEQKLQ

SEQ ID NO: 5736 - protein, 180 aa, Bacillus licheniformis
MAERMVGKQAPRFEMEAVLANKEFGKVSLEENMKNDKWTVLFFYPMDFTFVCPTEITAMSDRYDEFEDLDAEVIGVSTDTIHTHLAWINTDRKDNGLGQLKYPLAADTNHEVSREYGVLIEEEGVALRGLFIINPEGELQYQTVFHNNIGRDVDETLRVLQALQTGGLCPANWKPGQATL

SEQ ID NO: 5737 - protein, 152 aa, Bacillus licheniformis
MKLRQPMPELTGAKEWLNGEVTKEQLIGEKPTLIHFWSISCHLCKEAMPQVNEFRDRYSDKLNVVAVHMPRSEDDLDLNKIKEVAAEHDITQPIFVDSDHKLTDAFENEYVPAYYVFDKTGQLRHFQAGGSGMKMLEKRVNRVLAETEQSAE

SEQ ID NO: 5738 - protein, 196 aa, Bacillus licheniformis
MFNEREALRLRLEQLNEAEVKVIREYQIERDNIYAKLRELDRPSSFNDTKKDFRPERKTESLPVLAELAAQEMKSYQQQQQQQPQASQKNQQQTSPQTSSLPAGIPDGTTRRRRGTARPGSKAAKLREAAIKTLKRHNAAIKSSELQKEIEKESGLEIPNMTTFMQSLIKMYPEVKKPYRGQYILEGEISTETEQQ

SEQ ID NO: 5739 - protein, 318 aa, Bacillus licheniformis
MKKTSGSLPYFQDLSQENLFLKAELARSHQLIHELEASYFHQKNHKLSRENAAMKQQLQQLSFELERISANKEDKSAETLNRIKSELLSKIVVLQELLQKETYARKQEIEEKHRLHLTNVKAEEEKKSLHSQIEYEKLHAEREKTLREKKEQELKNAAYENARLKDELHAKSLQLKQIETDVAVLKERVTETKSRLLEAEKTKEALFYETILSYKRQLDESDKWIASHFADIDAFQQTEKALEQNEEVFERTEQIEAVLQTVTEQVDQLQQQLSAIQQNDTKMDQKITEWKKQAKEETPPQKWVYQIKRKDKETKPLN

SEQ ID NO: 5740 - protein, 134 aa, Bacillus licheniformis
MLEDIEPYRGKGPLAGMYTAMERAEGECYIFSACDTPLVRQETISALKRQLTPADDAVVPVADGRAQPLVAVYHRRVKSVLHEQLQQNELKISSFLDRIRVKYIEADAVGAEPWEFINVNKKSDLEEIEPFFPG

SEQ ID NO: 5741 - protein, 360 aa, Bacillus licheniformis
MFFKEQQTEKWYDIEKEVKGIILMHERYSRQIRYQNIGQAGQDRIRQSHVLIVGAGALGTSAAEGLVRAGIGALSIIDRDYVEWSNLQRQQLYTEKDAEERLPKAAAAKERLSEINSGVELRTYVADGTVETLRPLIEEADAVIDATDNFETRMIINDLAQETGTPWVYGACVSSQGMYMTIIPQKTPCLACLFEDVPIGGATCDTSGIISPAVQMVSAYQQAEILKILTGQQEALQTAFVTFDLWANTHYRMQIGRNEKCPSCGETPVYPFLSNMSQKKADVLCGRETVQIRSEMLKRLPKEELMKKLSVIGKVDANDYLLHVQYEAFRIVIFNDGRALVHGTNDIKEANSILARVIGM

SEQ ID NO: 5742 - protein, 430 aa, Bacillus licheniformis
MIEKRTPIPVFEAAARVSQHQKLGDAEWIHLEESLHRFLAEDVKADHDVPAFDRSPYDGFAVRACDTAGASGENPLQFEVVDHIGAGAVSDKKLGSFQAVRIMTGAQIPEGADAVVMLELTKTFSEDGKNYMVLKRSLQPGENISKTGEDARKGSVLVKKGTRITPGVVALLATFGYAAVPAVKKPVVGIIATGTELLNVSDPLVPGKIRNSNAGMAAAQVEESGGKPLYLGKISDQFDESFAAVEKALDKVDFLITTGGVSVGDFDFLPAIYEKLGAEVLFNKVAMRPGSVTTVAQLNGKLLFGLSGNPSACFVGFELFVKPSLRTWLHHPKPYSLCAEAVLAKDFPKPNPFTRFVRSFVSIQDGALQAEPVGLDKSSAVTSLADANALMVLPGGTRGFEAGARVHVLLYRDENGSEQLWPHIFQSSRS

SEQ ID NO: 5743 - protein, 175 aa, Bacillus licheniformis
MAAHFPILQIVGYQNSGKTTFVEKLAGKLDQLGVNVGCLKHHGHGGEPDAFAEGKDSDRFFRAGAAASGVEGAGVFQLTARGEWTLDQLIAAYGVLAVECLLIEGFKHAPYQKVVMVRNEADCRLLKELDGIIAVIYQQSEPKTDVPSFHIEDPGALAFILNHLKEEGVCLNDLS

SEQ ID NO: 5744 - protein, 164 aa, Bacillus licheniformis
MSERFIITKDPIVIEDVVKKVERREAGAVTTFIGTVREWTNGKKTLYLEYEAYVPMAVSMLAQIGKEINEKWPGTAAAITHRIGRLDISDAAVVIAVSSPHRKAAYEANEYAIERIKQIVPIWKKEHWEDGETWIGDQLETTEYPEGKPDIEEAASGRERGADH

SEQ ID NO: 5745 - protein, 77 aa, Bacillus licheniformis
MIKILLFAQLAEQAGAQSIDIDEEKTTTDEIRQFLKETYNLQGTDRAMIAVNEVYRRGNSEVESGDTVAFIPPVSGG

SEQ ID NO: 5746 - protein, 125 aa, Bacillus licheniformis
MSKREALKKRLLLLGELEQKIWKDFRKEREGIYARLGELDRQIQRHRRSNKEYYAAHCVDIIKQQKGEIVTTKELKMKLKERTNFNVHRISELYDLIQKLEPNISKERRGCFLYIENGSKKNVGR

SEQ ID NO: 5747 - protein, 585 aa, Bacillus licheniformis
MESLKKLKDFYWPYKKMFLWSIASMLLMTAITVVYPIILQMTIDEVILGGKYGLVIWISLGFIAVMAAKGAATFFHQYLGDMFGIRSVYRLRKELYAKLQRLPFKYYDSAKTGDLMSRLTADVEGIRFFLSFGFAEAIRFILLVTFSLSVMFSYSVPLTLVTIASLPFLGAAVYRFDKKVHPAFRNIRKSFARLNTKVQENISGMNTVKSLSKEDFEIQNFTHSNDHFRTKNLNASFIMSKFFPLMEFIGNICLVALLSFGGWLVMQNSLKPGELVAFFSLVNYLMWPIMNLGYVINLFSQAKASGERLLEILDAEEEITDTEQAVKSGRLNGDVAFSDVSLQYTKENAEALHGVSFQAERGKTIGLIGATGSGKSSIIQLLSRFYEPTSGRITIDGKPLEHYSLKMLRSNIGVVPQESFLFSSTIRSNISYGKPDASMDEIIESAKRAQAHDFIMELPNQYDTMLGERGLGLSGGQKQRIAIARAICMNPGILILDDSTSAVDMETEHRIQLALREVMRDRTTFIIAHRISSLKHADEILVLDKGVVKERGTHEQLMEANGLYKRIFDLQYKDQNVLNEPHFAG

SEQ ID NO: 5748 - protein, 606 aa, Bacillus licheniformis
MENQAKKQTLMNRFFYTSDQIIEKPFNWAQMWRLLKYLKPYRKNLLPLSFLTVMISAAIRLAVPILIGVYALDQAIAGRDMNLLVILISVISGLYLVNYVSNVLRIRWMNKLGQHVIYDLRQHLFTHVQRLSHRFFDERSAGSILVRIMNDINSLQELFTSGVINLLMDILLLFGIVVILFSLSPELTIAIMVTLPVMFFISTNLRRKIRRSWQKVRLKQSKLNSHLNESIQGIRVTQAFTQEKENMMYFEGVNSENFEAWREATKKNATFRPLVEMTNAVGTAILIWYGSSLIINETITIGVFVSFAFYLGMFWEPISRLGQVYNQLLMGMASSERIFEFLDEKPSVADKEDAVKIKELKGRIEFEQVEFSYDGNRKALHSISFEIPAGSSLALVGHTGSGKTTIANLISRFYDATGGAVKVDGIPITDISLSDLRSQISIVLQDTFIFSGTIMENIRFGRPNAADEEVIEAAKAVGADSFISALPNGYATEVEERGNVLSAGERQLISFARALLADPRILILDEATASIDTETEVKIQAALKTLLHGRTAIMIAHRLSTIRDADKILVLDHGRKIEEGNHQELIGKRGMYYELVKAQYQMFQRN

SEQ ID NO: 5749 - protein, 226 aa, Bacillus licheniformis
METNLETEKVKNPSLLGLITRPGEQFERMREKPAFWFPLVIVLILSVAGAYMLSEKTALSTDLSEMPDAEAFQAAMKGIGIIGGIFGFVIALLISALIYWLIVKIGRGTTNFVHMFSLSVFTYFIAAIGQFIGGLVIYYSNIDPTIVVTSLNGIIPADEPLKSVLGVFDIFTIWSLSLVALGLQKVGGISKKAAWTGVIILFVISILLALIGGMAINFFDSFEGAM

SEQ ID NO: 5750 - protein, 378 aa, Bacillus licheniformis
MKKIWIGIVIVGAAALFIGLNLYRSVQTSGGAEEAVQTVKLEEKEISSEVMVPGTLQFANEQYEYFEPEKGEIADIKVKEGDKVKKGDVLFTYTNEEIRLEKEQNALSIQSKDLQLEQVKRKISSLKSKEDELKAELGAEKAKRQIDEERSQLEMEEKSLQLELKQADLQKETLEKKSAALQVKSGIDGTVITVDKQAAAKQSDIQKPVIHIGNEDKLVVKGVLSEYDTLKVKKGQNVTITSDVIQNKEWRGRVSQVGLVPKEEASAGVAGTKEQAVQYPFEVKIKGERPKAKSGFNMILKIQTDKRIVQALPEDAVKQDGDQSYVFAVRDGKAKRINVKTGEKADGLVEITGGLTNKDPVIANPAEDMKSGTEVKLQ

SEQ ID NO: 5751 - protein, 230 aa, Bacillus licheniformis
MIELSKVKKSYQIGGETIDVLREIDMKIEPGEYLSIMGPSGSGKSTIMNIIGCLDRPTSGIYRLDGEDISSYGERELAGVRNRLIGFVFQQFQLLPRLNAIKNVELPMIYGGVPRKERRERAERALEKVGLKDRMRHMPNELSGGQKQRVAIARAIVNEPKLILADEPTGALDTKTSRDIMEQFTELNEEGTTVVLVTHEPEIADYTSRTIMVRDGVIVSPETERRGTVQ

SEQ ID NO: 5752 - protein, 397 aa, Bacillus licheniformis
MNLIENLRMALSSILSHKLRSILTMLGIIIGVGSVIVVVAAGQGGEQMLKQTISGPGNTVEIYYQPSNEELTANPNAYLDAGFTEEDIRSLKSLEGVKHVVAKTTESMNARFRDENTDAAVNGINDGYISINSMEIEKGREFSEEDYLAGSRVAIISPKLAEELFSQQSPLGRVVWINSQPVEIIGVLKEETGLLALGMNEMYVPFSMLKSSFGISDYDSVSVQAESADDLQAVGKRAAAAVNKNHGTSDSYEVMNMEAIAAGISQITTIMTMFIGSIAGISLLVGGIGVMNIMLVSVTERTREIGIRKSLGATRGQILMQFLIESSLITLIGGVFGIGLGYGGAALVSFFAGWPPLVSWQVVLGGVLFSMAIGIIFGLIPANKAARLHPIDALRYE

SEQ ID NO: 5753 - protein, 250 aa, Bacillus licheniformis
MTPERHQLIIDEIEKHDVVKIQYLMNLTNASESTIRRDLSTLEARGYLKRVHGGASRLSDIRTEPDMLEKSSKNLHEKRKIAQEAASLLEEGDCIYLDAGTTTLQMIDFINPEMDIIVVTNGVMHIEALGKKGITFYLLGGYVKYKTGAIVGGSALSAISQYRFDKSFIGVNGIHKEAGFTTPDPEEALLKTKAVNQAKKAFILADVSKFGEISFSAFAGLDEATIITAGSAKHSFDNYQEKTVVKVVKT

SEQ ID NO: 5754 - protein, 303 aa, Bacillus licheniformis
MIYTVTLNPSVDYIVHVEEFSVGGLNRSVYDTKYPGGKGINVSRVLNRHHVPSKVLGFIGGFTGGYIKSFLEEEKLETAFHEVNGDTRINVKLKTGDETEINGQGPVISEEDFAAFLDQFSAMKEGDIVVLAGSIPSSLPQDTYEKIAEKCKEQNVRVVVDISGEALLKAAEMKPLLMKPNHHELGEMFGTTITSAEEAVPYGKKLVERGAENAIVSMAGEGALLCTKDGVYHANVPKGKLVNSVGAGDSVVAGFLAGIEKQLGIKEAFRLGVASGSATAFSEELGTEELVHKLLPEVQVKAI

SEQ ID NO: 5755 - protein, 631 aa, Bacillus licheniformis
MKITELLTKHTIKLNLESSQKENVIEELVSVLDQAGKLNDKEGYKEAVINREKQSSTGIGEGIAIPHAKTASVKEPAIAFGRSKGGVDYESLDGQPSHLVFMIAATDGANNTHLEALSRLSTLLMREEIRKQLLEASSEDEIIDIINQHDKDDDEEEEQAEEAPAPSAKGKILAVTACPTGIAHTFMAADALKEKAKELGVDIKVETNGSSGIKNGLTAQEIEDAVAIIVAADKQVEMERFQGKHVIEVPVTAGIRRPQELIEQALKQDAPIYQGKGGGATASEDGAAKGKGGGFYKHLMSGVSNMLPFVVGGGILVAISFFWGINATKPGDPTYNEFAAVLNNIGGTNALGLIVAVLAGFIAMSIADRPGFAPGMVGGFMATQAGAGFLGGLIAGFLAGYIVVLLKKVFAGLPQVLDGLKPVLLYPLFGIFLTGIIMQYVVNTPVKYIMDGMTHWLEGLGTGNLVVMGIVLGGMMAIDMGGPINKAAFTFGIAMIEAGNFGPHAAIMAGGMVPPLGIALATTFFKNKFSKRDREAGITNYVMGLSFITEGAIPFAAADPARVIPACIIGSAVAGGLSQFFHVTLQAPHGGIFVLFFTTNHALLYLLSILIGAVVTALILGVLKKPVPTEK

SEQ ID NO: 5756 - protein, 186 aa, Bacillus licheniformis
MTEEKSTNKKNSLFEWVKAIIIAVVLALLIRAFLFEPYLVEGTSMDPTLHDGERLFVYKTVRYVGEFKRGDIVIIDGDEKNVHYVKRLIGLPGDTVQMKDDTLYINGKKVSEPYLSENRKEAEAVGVKLTGDFGPVKVPEGKYFVMGDNRQRSMDSRNGLGLIDKKRVAGTSQFVFFPFNEIRKTD

SEQ ID NO: 5757 - protein, 89 aa, Bacillus licheniformis
MKLITLTEYCMFIFFAGVYLAITGFTARDLGLYIGIAMIYVFVHIAAKRMLSKRGKEAAEIRILYSVLLIMASVFVTVLFIAVLASLSA

SEQ ID NO: 5758 - protein, 80 aa, Bacillus licheniformis
MKLKDDPDIIRWINSRPRQALFASVAMVISTMSIGLFKGFDMWTADFFIFSCLLIGFGLLVGWLQKIYYKKVIFEENSDR

SEQ ID NO: 5759 - protein, 539 aa, Bacillus licheniformis
MIAVQNVSLRFADQKLFEDVNIKFAPGNCYGLIGANGAGKSTFLKILSGEIEPQTGEVHMSPGERLAVLKQNHFEYEEHEVLKVVIMGHRRLYEVMQEKDAIYMKPDFSDEDGIRAAELEGEFAELNGWEAEGEAAILLKGLGIPEELHTKKMADLGGSEKVKVLLAQALFGKPDVLLLDEPTNHLDIQAIQWLEEFLINFENTVIVVSHDRHFLNKVCTHIADLDFNKIQIYVGNYDFWYESSQLALKMAQEANKKKEEQIKQLQEFVARFSANASKSKQATSRKKLLEKITLDDIKPSSRKYPYVHFAPEREIGNDVLVVKDLSKTIDGVKVLDSVSFMMNKEDKIAFTGRNELAATTLFKILAGEMEPDSGSFKWGVTTSQAFFPKDNSEYFENSDLNLVDWLRQFSPHDQSESFLRGFLGRMLFSGEEVLKKASVLSGGEKVRCMLSKMMLSGANVLMLDEPTNHLDLESITALNNGLISFKGAMLFTSHDHQFVQTIANRIIEITPNGIVDKQMSYDEFLEDKTVQDKLAELYA

SEQ ID NO: 5760 - protein, 124 aa, Bacillus licheniformis
MSCRKALEQYIQATNTHEFENVKALLDPGAVYWFSDQTCSGFEEIQRYFENAWKQIENEVYSAGHVSWITETDEQAVCLYTYEWKGLYRGEPVQGAGRATNVFVKDESGRWKLKHEHLSSLPKR

SEQ ID NO: 5761 - protein, 410 aa, Bacillus licheniformis
MNSFTDKLSKYAKLVAEVGVNVQKGQQVVINASTEVRDFARLLVKSAYQRGAKNVTVRWQDDEVTRLKYELAPAEAFEEFPEWEAKGLETLAKEGAAFISIVSSSPDLLKGIDSKKISAQQKAAGKAMHTYRQMIQSDKVSWTVVAAPSPAWAKKVFPEADEETAVQKLWNEIFKTTRVDREDPVQAWKDHDQTLRDKVSVLNDKHYHALHYQAKGTDLTIELPEKHLWVGAGSTNENGVEFMANMPTEEVFTAPKKDGVNGTVSSTKPLSYGGNLIDGFTLTFKNGRITDVKAGQGEEILKELIETDEGSHYLGEIALVAHDSPISKSNILFYNTLFDENASNHLAIGSAYAFNIEGGKQMSREELAKEGLNESITHVDFMIGSGEMNIDGITADGKREPIFRNGNWAI

SEQ ID NO: 5762 - protein, 54 aa, Bacillus licheniformis
MRNGETIRRKTMLRDMGRRLAITVILSGIILGGMSISLANMPSSPPGQTAKINR

SEQ ID NO: 5763 - protein, 335 aa, Bacillus licheniformis
MFQTTEIGIDLGTANILVYSKNKGIILNEPSVVAVDTETKSVLAVGTEAKNMIGKTPGKIVAVRPMKDGVIADYDMTTDLLKQIMKKAGKNIGFTFRKPSVVVCTPSGSTAVERRAISDAVKNCGAKQVHLIEEPVAAAIGADLPVDEPVANVVVDIGGGTTEVAIISFGGVVSCHSIRIGGDQLDEDIVSFVRKKYNLLIGERTAEEVKIEIGYALIDHETKTMEVRGRDLVTGLPKTITLESKEIQKAMRESLLHIIEAIRATLEDCPPELSGDIVDRGVILTGGGALLNGIKEWLSQEIVVPVHVAANPLESVAIGTGRSLEVIDKLQKAAK

SEQ ID NO: 5764 - protein, 89 aa, Bacillus licheniformis
MRKVDELGRIVMPIELRRALDISIKDSIEFFVDQDKIVLKKYKPHGVCLMTGEITSENREYGNGKITLSPEGAELLLEEIKAALNGVKA

SEQ ID NO: 5765 - protein, 445 aa, Bacillus licheniformis
MKRYQGRIIATVLAMTFIMFWNFLFYGVLGNKINWTVDLLFTLVTLISVWWLTLYIDESNQLVYKLKESEKKYKELSSETNRIMDNLQEIVFQTDRIGYITFLNQAWTTLTGYSVEESLGTMYNDYFDHEERISNHLIAQLKNKEPEGRIEVLYHRKDGSKFWGEVHYKLYYKNGQFTGSLGTLTDVTERKKAEMELFKSNQRLAMQSQKLAMAGQLAAGIAHEVRNPLTSVNGFLQLMKAEYPDRKDYFDIIFSEIKRIDSVLGELLVLAKPHQVQFKKIKINSVLQQVATLLETNAVLSHIKIEKAFQHGEEWEINGDENQIKQVFINLIKNGIEAMPDGGKITISSKAEGDCVKISIKDEGGGISQADLAKLGEPFFSTKEEGTGLGLTICLNIIGAHNGEMKIDSKLGEGSTFHILLPVDKGAASEENDIQQGCCSRATIK

SEQ ID NO: 5766 - protein, 220 aa, Bacillus licheniformis
MKKEFAVIGLGRFGGSICKALSEEGLEVMAIDRDEDRVNEYAKIATHAVIGDTTDESVLKNLGLRNFDHVIVAIGENIQASILTTLILKELGVKMITVKAQNDYHEKVLSKIGADRIVHPEREMGKRIAHNIVSNNVLDYLELSDEHSLVEIAANGKLAGNTLLDLDIRARYGINIVAIKRGKEVIVSPLATEEIQKDDILIVIGSNPDIERFEKKVFQH

SEQ ID NO: 5767 - protein, 573 aa, Bacillus licheniformis
MDKEMFIRRLGAASHRKKAETVIKNGKIMDVFNQEWLETDIAITDGAIVGLGEYEGGNIIDAEGQMIVPGFIDGHVHIESSMVTPPEFAKAVIPHGVTTVVTDPHEIANVSGVKGLEFMLEQAEMTRLNIYFMLPSCVPAAPFEKSGAILNAADLHPFYSREEVLGLAEVMDYVAVEAGEPDMVQKLIDADKAGKRIDGHLAGLSAGFVNVYRAAGVLTDHEVTTPEEALERVRRGMYVMLREGSAAKNTRHVLPAVNEKNVRRFFFCTDDKHLDELVDEGSINYQVKLAIQEGLDPFLAYQMGSLNAAECFGLKTKGAVAPGYDADLLFISDFENVSITKTMINGVIWSGTEQSQSTGGKAASGLLQSVHLSDLHENDLQIPIVQENEIRVIDIIPNQLETKLSLAKPKSGAFFQPDLESDLLKIAVVERHRGVKEIGLGVVRGFGLKEGAIATTISHDSHNLIAVGTNDQDILKAIERLGEIGGGLTIAKGGKELQSVALPIAGLLSDKPLETVNESLKSLHAAITETGFSGAFNPFLTLSFLALPVIPDIKMTTEGLFDVKAFRHIPVQP

SEQ ID NO: 5768 - protein, 555 aa, Bacillus licheniformis
MKFVKNDQTAVFALGGLGEIGKNTYGVQFQDEIVLIDAGIKFPEDELLGIDYVIPDYTYLVKNEEKIKGLFITHGHEDHIGGIPYLLKQVNIPVYGGQLAIGLLRKKLEEHGLLRQTKLHIIEEDDIVKFRKTSVSFFRTTHSIPDSYGIVVKTPQGNIVHTGDFKFDFTPVGEPANLTKMAEIGKEGVLCLLSDSTNSEIPDFTMSERKVGESIDDIFGKVEGGIIFATFASNIHRLQQVIEAAVANGRKVAVFGRSMESAIEIGQTLGYIKCPKNTFVEANEINRLPAGKVTILCTGSQGEPMAALSRIANGTHRQISINPGDTVVFSSSPIPGNTISVSRTINQLYRAGADVIHGAVTNIHTSGHGGQEEQKLMLRLIKPKFFMPIHGEYRMQKMHVKLATDCGIPEENCFIMDNGEVLALTSEEASVAGKIPSGNVYIDGSGIGDIGNIVLRDRRILSEEGLVIVVVSINMKEFKVSAGPDLISRGFVYMRESGDLINDAQELIAGHLKKVMERKTTQWSEIKNEITDTLAPFLYEKTKRRPMILPIIMEV

SEQ ID NO: 5769 - protein, 69 aa, Bacillus licheniformis
MIYKVFYQASNDEVPVREKTDSIFVEAQSEREVRSKLKPYNYNIEFIQQVEGAFLEYEKQSENFKVLEL

SEQ ID NO: 5770 - protein, 258 aa, Bacillus licheniformis
MDKKLIFFDIDGTIYDHNKRIPATAKQAVSDLKAHGHHVFIASGRAPFMVRPVLEELGIDSFVSYNGQYVVFEGEVIYKNPIAEQSLEALLAHSDSCGHPLVFMGEEGMRSTTAAHPFVDEGIGSLKVNPPEEDRTYFKGRDIFQVLLFCTQDEEERYSRFKEFDLVRWHERSTDVLPSGGSKAEGIKKVIEKLPFDREDTYAFGDGLNDLQMIEFAGTGVAMGNAVPELKKIADFITKPVDEDGIQYAVEALGLLKS

SEQ ID NO: 5771 - protein, 184 aa, Bacillus licheniformis
MITMENIVRDGHPALRTVAEEVQLPASEEEIKQLSEMIEFVKNSQDPEIAKKYNLRPGVGLAAPQININKRMIAVHAESEDGTLYSYALFNPKIVSHSVQRCYLTSGEGCLSVDEPIPGYVPRYERIRVKGTTLEGENIDIRLKGYPAIVFQHEIDHLNGIMFYDHIDKENPLKQPENATPVGR

SEQ ID NO: 5772 - protein, 43 aa, Bacillus licheniformis
MYGYCCPGYGYGGGYGYGYGRTFALIVVLFILLIIVGAAYLGC

SEQ ID NO: 5773 - protein, 222 aa, Bacillus licheniformis
MKFSNMRVPAGIVVFCTAAFVLTGCLWKDPVESFHGSLEKIVELEEPFKQEQGSLKSLEKAESKLYEEMIRLNMDDFDRIAALSDKALKTAGKREKHLNSEKESIDEAKQEFEANKASAEKIDDQKVRKKAENAASYMEKRYKAYDSLYGAYQNAIGLDKELYKLLKNKGLKLDDLEEQLKKINQSYDKVLKESKHFNEYTKDYNKARKDFYKAAGFEMKEG

SEQ ID NO: 5774 - protein, 371 aa, Bacillus licheniformis
MAAKTKKAIVDSKKQFDAIKKQFETFQILNEEGEVVNEAAMPDLSDDQLKELMRRMVYTRILDQRSISLNRQGRLGFYAPTAGQEASQIATHFALEKEDFVLPGYRDVPQLIWHGLPLYQAFLFSRGHFRGNQMPDDVNALSPQIIIGAQYIQTAGVALGLKKRGKQAVAITYTGDGGASQGDFYEGINFAGAYKAPAIFVVQNNRYAISTPVEKQSAAQTIAQKAAAAGIVGVQVDGMDALAVYAATREARERAVNGEGPTLIETLCFRYGPHTMAGDDPTKYRTKEIENEWEQKDPLVRFRKFLENKGLWSEEEENKVIEEAKEEIKQAIKKADEEPKQKVTDLIDIMYEELPYNLVEQKEIYKEKESK

SEQ ID NO: 5775 - protein, 325 aa, Bacillus licheniformis
MAQMTMIQAITDALRTELKNDENVLVFGEDVGVNGGVFRATEGLQKEFGEDRVFDTPLAESGIGGLALGLGLQGFRPVMEIQFFGFVYEVMDSVSGQMARMRYRSGGRWNSPVTIRSPFGGGVHTPELHADSLEGLVAQQPGLKVVIPSTPYDAKGLLISAIRDNDPVVFLEHMKLYRSFRQEVPEEEYTIEIGKADVKREGKDLSIITYGAMVHESLKAAEELEKEGVSAEVVDLRTVSPLDIDTIIASVEKTGRAIVVQEAQKQAGVAANVVAEINDRAILSLEAPVLRVTAPDTVFAFSQAESVWLPNHKDVLETAKKVLEF

SEQ ID NO: 5776 - protein, 430 aa, Bacillus licheniformis
MAFEFKLPDIGEGIHEGEIVKWFVKPNDEVNEDDVLAEVQNDKAVVEIPSPVKGKVLELKVEEGTVATVGQTIITFDAPGYEDLQFKGDESGEAKAEEAEKQETDAPAEAAEANEQADADPNKRVIAMPSVRKYAREKGVDIVNVSGSGKNGRVLKEDIDSFLNGGTAGDAKAAQAEEKAEPAAQQPAAAVQVPEGEFPETREKMSGIRKAIAKAMVNSKHTAPHVTLMDEVDVTNLVAHRKQFKQVAADQGIKLTYLPYVVKALTSALKKYPVLNTSIDDNTDEVIQKHYYNIGIAADTEKGLLVPVVKNADRKAIFEISNEINELATKAREGKLAPAEMKGASCTITNIGSAGGQWFTPVINHPEVAILGIGRIAEKAVVRDGEIVAAPVLALSLSFDHRMIDGATAQNALNHIKRLLNDPQLILMEA

SEQ ID NO: 5777 - protein, 470 aa, Bacillus licheniformis
MVVGDFPIETDTLVIGAGPGGYVAAIRAAQLGQKVTIVEKGNLGGVCLNVGCIPSKALINAGHRYENAKHSEEMGITAENVKVDFTKVQEWKASVVNKLTGGVEGLLKGNKVDIVKGEAYFVDSNSVRVMDENSAQTYTFKNAIIATGSRPIELPNFKYSDRVLNSTGALALKEIPKKLVVIGGGYIGTELGTAYANFGTEVVILEGGEEILPGFEKQMSSLVKRNLKKKGNVEIHTKAMAKGVEEKADGVTVTFEVKGEEQTIDADYVLVTVGRVANTDELGLEQVGVEMTDRGIIKTDKQCRTNIPNIYAIGDIIEGPPLAHKASYEGKIAAEAIAGEAAEIDYLGIPAVVFSEPELASVGYTEAQAKEEGLSVTAAKFPFAANGRALSLNETDGFLKLVTRKEDGLVIGAQIAGASASDMISELSLAIEAGMTAEDIAMTIHAHPTLGEITMEAAEVAIGMPIHVVK

SEQ ID NO: 5778 - protein, 286 aa, Bacillus licheniformis; identical to SEQ ID NO: 4681

SEQ ID NO: 5779 - protein, 110 aa, Bacillus licheniformis; identical to SEQ ID NO: 4682

SEQ ID NO: 5780 - protein, 100 aa, Bacillus licheniformis
MPDQQHQSTNHRHLKLIFFSDDEHMEQEVAYYDALLDLKKEFPEQVSSMEISHDKGEWKKEVKVFPSLLLVNDKKVLVKIEGKIKDKDKIVRLLQKELKH

SEQ ID NO: 5781 - protein, 39 aa, Bacillus licheniformis
MGTIVCQDCNETIQHFEDEKVTILYGTCGQCNCHLKEEE

SEQ ID NO: 5782 - protein, 496 aa, Bacillus licheniformis
MKVGKQLLQHETPLYTGLKKHAGKNPIQFHIPGHKKGSGMDPEFREFIGENALSIDLINIEPLDDLHAPKGIIKQAQDLAAEAFGADYTFFSVQGTSGAIMTMVMAVCGPGDKIIVPRNVHKSVMSAIVFSGAVPIFIHPEIDDELGISHGITPESAKKALLEHPDAKGLLVINPTYFGIAADLKSIVELAHSFHVPVLVDEAHGVHIHFHEDLPLSAMQAGADMAATSVHKLGGSLTQSSILNMKEGLVSKERVQSILSMLTTTSTSYLLLASLDVARKRLATEGHELIEQTIKLANETRERINNINGISCVGREILGSKAAFDYDPTKLIISVKDLGLTGHDVEKWLRESCQIEVELSDLYNILCIFTPGDRKEDADALIKGLTEIAQQAASSAENRRKPEVLLPNIPALAMTPRDAFYANTEIIPFKKAAGRMIAEFVMVYPPGIPIFIPGEIITEDNINYIEKNLEAGLPVQGPEDDTLHMIRVIKEQQAIL

SEQ ID NO: 5783 - protein, 91 aa, Bacillus licheniformis
MEEGYQYPMNEDWSTEEAIDVISFFQAVELAYEKGVERDVLMSAYRRFKEIVPGKAEEKKLCSQFEEASDYSPYQAVKKAKEQTEDTKIKM

SEQ ID NO: 5784 - protein, 211 aa, Bacillus licheniformis
MSSLRFTEEDFRTFTIEGLDARMSVLKDTVRPKLQGLGDHFAPVLSALTGDEMFVHVAKHARRSVNPPDDSWVAFANNKRGYKKLPHFQIGLWETHVFVWFALIYESPLKQEYGQLFKKHLPDIESSIPSRFFWSADHTKPDAKRQSEMNEKDLENLFERLVNVKKAEALCGIQLSKDEVLHMSEEAFLSEIEAAFEKLAFLYRLTQKVSV

SEQ ID NO: 5785 - protein, 62 aa, Bacillus licheniformis
MKPIVKQGLKEEKDNRAAVWRLEVDYELATLFEAMEKKDETQIELSKRKLERLRKEWIRLHG

SEQ ID NO: 5786 - protein, 264 aa, Bacillus licheniformis
MTNWKEIDRLAKSWVKEAGQRIKQSMKEKMTIETKSNPNDLVTNIDKETERFFIEKIQSVFPDHHILGEEGQGDKLTSLDGVVWIIDPIDGTMNFIHQKRNFAISIGIFENGKGKIGLIYDVTHDELYHAFQGEGAYMNNTKLGKMKEVPLEESILAINATWITENRRIDPSVLSPLVRRVRGTRSYGSAALELAYVAAGRMDVYVTMRLAPWDYAAGCILLDEVGGTYTTIDGKPLNFLENHSIVAGNPAAHRAIFDEYLPHE

SEQ ID NO: 5787 - protein, 155 aa, Bacillus licheniformis
MNSRSFSSSDLAFFEELAEASPGWVKEELDGNSLERYMSAYAMYNGEWLVWEDGGLPAALSFHLEWAPSNGKPWLGTLLVHPDFRKKGRAKEVIKTIGKRLREKGHKALFAAVPYEKDEWLNMLARSGFEQLKTEKDEKGKRYLIMVLPLPLWLQ

SEQ ID NO: 5788 - protein, 641 aa, Bacillus licheniformis
MIELFSDYVLHFERYFVLSRQSMLVIQWCVTGLVLLYAVSFHPKVCRRRLFFYAGIVLRLILVGALSFELAHQMKAAEFSNLYIDEQDALLPFMQFLLFGYILLVSFHYMMTLAEKGGKGLFFAFDIAVMAMPLFQSLFSFAAYLKEFGAEELEELPLVLLLIVGIPGLMICLFFQLYWKRNRYVLLLIFYIVTIGGFFIKKLGYEFFPLNVFLTMIGFLMTYHLLNDSRKPLLMVKRVLAAGTAVFFTLHLNPFYNLADAAFTISHPEVSDVVDANFRPVSVKEAKQTVSSFFPTESFIYLSATNQDFHNVYHFKTKDYDADVDGWTGMITNYHNQKKPSGNILSGQAYIKRSKQFLREHGRELDKQIKAKVSRDDGEATVEFYREGEDPELSTMWFTWRKETLMGFHEDASVYSLESVNQARVSGEDIERGVEAVYRKLGIPVSSYRLTDIDLLFPFSLNSASINIKTSDGMGMEFHPVTGALTAISIKSESALPYRGQELEKRLLSLFDQDISNLKRVELEKDLIEFQKKESDAVLNTVWTMTKHEEGAYLTVRKNFQKADEKPPYTYADGEKAFQKVSERYQKGLVYHKRTKLVIVSDGDQKSRYAWLVIIQPFGSNEHDAYLVDAETDEVKHFDDK

SEQ ID NO: 5789 - protein, 90 aa, Bacillus licheniformis
MTNEEKKAVFIDLYELYQESELEEETMIWMKEHEQFFQDQAEAAAAGNRELPGMQKTDDHQKLLHIKIFVYSLYGAFLLLSIWMTVWFFF

SEQ ID NO: 5790 - protein, 171 aa, Bacillus licheniformis
MAHNNKQTIEELYREYYHDIMYYLYRRTHQLETAKDLAQDTFLKAFAGLESFRGHSSIKTWLYTIAHHTFINWYRKDKKIQFSDVAACGDMEQHTFEMPERHLANAIMQEELKHHIDRLKEDYQTVLILREFQELSYEEIAEVLNWKLSKVKTNLHRARLELKKSLEGREV

SEQ ID NO: 5791 - protein, 98 aa, Bacillus licheniformis
MKCHLVRDLLPLYIEGDCSRKTERLVAAHIKTCEDCREMYDMMREPVNFHGDGGLPKEAEEAEEQKFRKAYYQRLILKGAALFGGGYLLMLLIYLFFL

SEQ ID NO: 5792 - protein, 62 aa, Bacillus licheniformis
MKQIKWIFLLFALAAVISIMMIGVAVAEKSAAGVAIAIAILIVIMGSGFTLKKRMREKGLLE

SEQ ID NO: 5793 - protein, 612 aa, Bacillus licheniformis
MKLREDLRNIAIIAHVDHGKTTLVDQLLHQAGTFRANENVAERAMDSNDLERERGITILAKNTAINYKDTRINILDTPGHADFGGEVERIMKMVDGVLLVVDAYEGCMPQTRFVLKKALEQNLTPIVVVNKIDRDFARPEEVVDEVLDLFIELDANEEQLEFPVVYASAINGTASADPKQQDENMEALFEAIVNHIPCPVDNHEEPLQFQVALLDYNDYVGRIGIGRVFRGTMKVGQQVALMKLDGSVKPFRVTKIFGFQGLKRVEIEEAKAGDLVAVSGMEDINVGETVCPIEHQEALPVLRIDEPTLQMTFAVNNSPFAGREGKYVTARKIEERLEQQLQTDVSLRVDPTPSPDAWIVSGRGELHLSILIENMRREGFELQVSKPEVIIKEIDGVRCEPVERVQIDVPEEHTGSVMESMGARKGEMIDMINNGNGQVRLIFNVPSRGLIGYSTEFLSLTRGFGILNHTFDSYQPVEPGQVGGRRQGVLVSMDTGKASAYGIQGVEERGVIFVEPGTEVYEGMIVGEHNRENDLVVNINKMKQQTNVRSATKDQTVSMKKPRIMSLEESLEYLNEDEYCEVTPESIRLRKKILDKNEREKAAKKKKLAGLS

SEQ ID NO: 5794 - protein, 106 aa, Bacillus licheniformis
MTDVSERLSFFAALYKVDQNPEAGMWWLYATIFVLSAVVFKLGFAKRLPLLKTAIIYFFLALGCTFLTFFGVFLPVGEGLIVAVLILSIYKIRLHRSKKEQTGANT

SEQ ID NO: 5795 - protein, 168 aa, Bacillus licheniformis
MEHLTHAKQEIFDLYIRLIHQQEQQETVMKERISAEMKKMEREFGAEMRLNMSDIHTISCIGDHEPINVTSISEKMEFSKATVSRITAKLTEKGLVSKTQLSDNKKEIYFRLSHKGRSIHHLHQREHDKIEQRFKRFLSRYSFDEILFARALFRDLLTADFLADTEKT

SEQ ID NO: 5796 - protein, 493 aa, Bacillus licheniformis
MDFDVLIAGGGPVGLLTASELALAGVRTCIVERLNEPSPFSKALTLHPRSIEILEMRGLGERFKEIGKPLGSGHFAGLKTGLDFSALDTRANFTLFIPQYETEKVLEEHARNLGVCILRGHEVLAVREHEDTAELVVQGPDGLSLLTASYIVGADGAGSTIRKQARIAFSGTDANITAMLGDVSLENPPESHFYTCVNREGGVVIVPLDGGIFRVLITAPHMPQALLHEPVTLEELKKELSRICGTDFGINSPVWMSRFGNASKLAEHYRSGRIFLAGDAAHIHFPAGGQGLNVGLQDAMNLGWKLAAKINGRCPGWLLDSYHHERHPVGKALIVNTQIQTKLFDFTREGLYLRELLSGILGFSDVNRYLAEQIAALSVQYEADEKMPEHELNGKRLPDIDLTLSDGTVKRLYTFHRDGRFLLAAFGKEPKEFSRLPHVRLMQLKAIDGRPEWNGVKAALIRPDGHIAWAVDESLENAEQLIADGIRRWCGNA

SEQ ID NO: 5797 - protein, 62 aa, Bacillus licheniformis
MCDKIEKIDDDTLIAKRLRNRPIHTYMCHECSERIKIKTENRMKTGRFKLYPHRKDKEQIKS

SEQ ID NO: 5798 - protein, 204 aa, Bacillus licheniformis
MRIFFLILIQTVMLLSACGIQNNARNEANELPGNRPIHVKNSAQEPVNREDGQAISRRLVKITESVPGVNDATAVVLGRLAVVGIDVKDNLERSKVESIKYSVAEALQNDPYGANAAVVADPDTVNRLRAMGREIQAGRPVKGILDELAAIVGRVLPEVPNDATDNQQTNPTKSNNDQLNERNQKQLEKKQNNQSNKHMKNRQQ

SEQ ID NO: 5799 - protein, 442 aa, Bacillus licheniformis
MSKIYVLDTNVLLQDPNSIFSFEDNEVVIPAVVLEEVDSKKRYMDEIGRNARRVSKLIDDLRLKGKLYENVPLPNGGSLRIELNHRSFQQLQEIFIEKTSDNRILAVAKNLSLEEETKEGGRPVILVSKDMLIRVKADAIGLMSEDFLHDRVVDNDDIYSGYTDVYIRSDQMNSFFEHHYLQLDEISEEPLCPNQFVVMKDALGGSSSAVGIVDQSGKAVKKLVFDQEQVWGIRSRNVQQTMALELLLRQDIPLVTLIGKAGTGKTLLALAAGLLQTEDLGNFKKLVVTRPIVPVGKDLGYLPGEKEEKLRPWVQPIFDNLEYLFNAKKPGELDDILAGMGSIQVEALTYIRGRSIPDQFIIIDEAQNLTKHEVKTLLTRVGEGSKIVLMGDTEQIDHPYLDAMNNGLAYVVERFKDQKISGNVKLLKGERSRLARLAADLL

SEQ ID NO: 5800 - protein, 160 aa, Bacillus licheniformis
MSIVTITGNVKYPITLDPSVWIFDDRKFDLEQFFSHFGEVQDEDDDLVIDRERQIREGAVSPPTLKSEKKYEKEKLLDGTFGIKLEPFLKNAEVSGSAVKCLFKTEGEDVSVPIEEAGGMILCFSNKGKPLGEDGPVHVYFPDGSNKMNPVKRVKEIHII

SEQ ID NO: 5801 - protein, 309 aa, Bacillus licheniformis
MNCRHNKELEYFVTEAKKVTDKGKVASYIPALAELSEDDLSAAVYFTDGTCISAGDVEKAFTLQSISKVLSLALVLIDHGPEKVFHYVGQEPTGDPFNSIIKLETVNPGKPLNPMINAGALVVTSMIKGETNADKIGRLLDFIKKLANNRSITVCGKVAESEFETSMVNRAMCYYMKEHGIFQAEVEDVMDVYTKQCAIEMNSLDLAKIGSVFALNGKHPETGEQIIPKDIARICKTFMVTCGMYNASGEFAIKIGIPAKSGVSGGIMGLSPYRFGIGIFGPSLDEKGNSIAGIRLLELLSANYSLSIF

SEQ ID NO: 5802 - protein, 93 aa, Bacillus licheniformis
MASEIVVDHREKALALLKRDADKILKLIQVQMDNLTMPQCPLYEEVLDTQMFGLSREIDFAVRLGLVDEEEGKELLYRLERELSALHDAFTKK

SEQ ID NO: 5803 - protein, 403 aa, Bacillus licheniformis
MIKRMLKSYDYSLIFAVFLLCGFGLVMVYSSSMITAVTRYGQNSSYFFDRQLMFLALGTVIFLCAALFPYKAFANQKFQKFLLLISVVALFGLFVVGHVAGNAQSWFRVSNYGIQPGEFVKLTVILYLSSVYAKKQSYIDNLGAGIAPPAIITLFICALVAAQPDVGTAFIIALIALCIILCSGFSGKTLLKLVLLAGIVLVLVSPLIYFNWDSILTEGRMKRFESYQNPFKDAGDSGFQVVNSYLAIGSGGLFGLGLGESVQKYGYLPETHTDFIMAIIAEELGIFGVLFVVLLLSFIVLKGFYIARKCDDPFGSLLAIGISSMIAIQSFVNLGGISGLIPLTGVTLPFISYGGSSLILLMASAGILVNISMFNEYFDRFKRKQPVNTTKTKENQYKKSINF

SEQ ID NO: 5804 - protein, 1147 aa, Bacillus licheniformis
MSQQSIQKVLVANRGEIAIRVFRACTELNIRTVAIYSKEDSGSYHRYKADEAYLVGEGKKPIDAYLDIEGIIEIAKRNHVDAIHPGYGFLSENIQFAKRCEEEGIIFIGPTSEHLDMFGDKVKAREQAEKAGIPVIPGSDGPVADIAEVKQFAEKFGYPFIIKASLGGGGRGMRIVRDESELVESYNRAKSEAKAAFGNDEVYVEKLIEKPKHIEVQVIGDKEGNVVHLYDRDCSVQRRHQKVIEVAPSVSLSESLREKICDAAVKLAKNVEYVNAGTVEFLVANDEFFFIEVNPRVQVEHTITEMVTGVDIVQTQILIAAGLSLDSSEISIPNQDAITLHGYAIQSRVTTEDPSNNFMPDTGKIMAYRSGGGFGVRLDTGNSFQGAVITPYYDSLLVKLSTWALTFEQAAAKMVRNLQEFRIRGIKTNIPFLENVAKHEKFLTGQYDTSFIDTTPELFVFPKQRDRGTKMLTYIGNVTVNGFPGIDKKKKPEFDKPQIVKTDVDQPIASGTKQILDERGAEGLVKWVKDQEEVLLTDTTFRDAHQSLLATRVRTHDLKKIANPTAALWPELFSLEMWGGATFDVAYRFLKEDPWKRLEELRKEIPNTMFQMLLRSSNAVGYTNYPDNLIKKFVSESAAAGIDVFRIFDSLNWVKGMTLAIDAVRESGKLAEAAICYTGDILDPNRSKYNLEYYTSMAKELEAAGAHILGIKDMAGLLRPQAAYELVSALKETIDIPIHLHTHDTSGNGIFMYAKAIEAGVDIVDVAVSSMAGLTSQPSASSLYHALEGDKRRPQFNVDAEESLSQKKKSVRKYYSEFESGMIAPHTEIYKHEMPGGQYSNLQQQAKGVGLGDRWNEVKEMYSRVNHLFGDIVKVTPSSKVVGDMALYMVQNNLTEDDIYERGESLDFPDSVVELFKGYIGQPHGGFPEKLQKLILKGQEPITVRPGELLEPVSFDAIKAEFLEKHGMELSDQDAVAYALYPKVFTEYVKTAELYGDISVLDTPTFLYGMTLGEEIEVEIERGKTLIVKLVSIGEPRPDATRVVYFELNGQPREVVIKDESIKSSVHQKVKADRSNPNHIAASMPGTVIKLLVSKGDQVKKGDHLMINEAMKMETTVQAPFSGTVENIHVTNGEAIQTGDLLIELKK

SEQ ID NO: 5805 - protein, 302 aa, Bacillus licheniformis
MNKALKGLGIITTIAMLFVLIGGALVTKTGSGMGCGRSWPLCNGSIFPALTLESIIEWSHRFVSGTSGVLVLALAIWTWKKIGHIRETKFLAVMSVVFLILQALLGAAAVVFGSSALIMALHFGISLISFASVLLLTLLVFEADSKQKSESFYIGKTMQFHMIGIIIYTYVVVYTGAYVRHTSSSLACLDFPMCSTENGWLPGKFHEWVQMGHRAAALLLFAWIIAAAVHAARQYKNQKRIYWGWMISLILIILQAASGIAVVYSRLDLGFALAHAFFISCLFGILCYFLLLVARYRRQVQK

SEQ ID NO: 5806 - protein, 308 aa, Bacillus licheniformis
MAETRITADTAMNGQIEETTAWKDFLALIKVGIVYSNLITTFTGMWLAFYFSNLSFLGNLDIVLFTLAGSSLIIAGSCVINNFYDRDIDQLMQRTRTRPTVTGKIQPSQALWFGILLTALGFIMLLMTNLTAAGVGFVGVFTYVFLYTMWSKRRYTVNTIIGSVSGAVPPLIGWTAVQGSIGVEAWVLFLIMFIWQIPHFLALAIKKTEEYRAANIPMLPVVHGFEVTKRQIIIWIACLMPLPFFLGGLGLPIVILGTVLNIGWLVCGLVGYRSKNIMKWATLMFVYSLNYLTIFFVAMVVFTLFKIG

SEQ ID NO: 5807 - protein, 355 aa, Bacillus licheniformis
MLKKWRLMSLFTILALVLAGCGEPFISTLQPAGEVADQQYFLMILSTLIMVVVVVVVSFIFVFVIVKYRRSKLGDDHIPKQVEGNRNLEILWTVIPIILLLILVVPVVAQTFDLADTKPMDKKNRDPEKTLVVNVRANLYWWEFEYPDYGVITSQELVVPTDERIYFKLKASDVKHSFWIPSVGGKVDTNTDNENKFYLTIDSKRAEKAGDYFYGKCAELCGPSHALMDFKVKAVSKDEFKKWMSDMENNKAEAKTDLAVEGEKVFKEKNCLSCHATDSKDQRAEAARTAPNLATFGDRSTIAGVKEFNDENLKAWLKDPESIKPGNKMTGTYPDLSDKELDALTEYLKGLKTED

SEQ ID NO: 5808 - protein, 622 aa, Bacillus licheniformis
MSTLKKKQGFGAVLWDYLTTVDHKKIAILYLLGGGFFFVLGGIEAMLIRVQLMIPNNDIMSGGVYNEIMTMHGTTMIFLAAMPLLFALMNAVVPLQIGARDVAFPFLNSLGFWLFLFGGIFLNLSWFLGGAPDAGWTSYASLSLHSEGHGIDFYVLGLQIAGIGTLIAGINFLATIINMRAPGMTYMRLPLFTWTTFVASALILFAFPPLTVGIALLMLDRLFGTSFFNPELGGNTIIWEHLFWIFGHPEVYILVLPAFGIFSEIIPVFARKRLFGYSSMVFATVLIGFLGFMVWAHHMFTTGLGPVANAIFAVATMAIAVPTGIKIFNWLLTAWGGSIKFTTPMLYAISFIPTFVMGGVTGVMLAAAPADYQFHDTYFVVAHFHYVIIGGVVFAILAGAHYWWPKMFGKMLSEALGKITFVLFFIGFHLTFFIQHWLGLWGMPRRVFTYLPNQGFDMANLISSIGAVFMAAAVIILVINIIVTTAKGEKVGSDPWHDGRTLEWAVSSPPPEYNFKQLPLVRGLDALWIEKRAGKQSMTAAEPLQDIHMPNGSILPFIMSLGLFISAFGFMYRTEFAWGLPVILIGLGITLFMMLLRSVIDDHGYHIHKEDLMDDDDKGVKA

SEQ ID NO: 5809 - protein, 207 aa, Bacillus licheniformis
MHTEEKLTAETFPASPEKATLEGKNKFIGFWLFLGGETVLFASLFATYLALKNSNAGGPKTTEMFDMGLVFLATMLLLTSSLTSVYAMYHMKNFAFKKMQVWLGITVLLGAGFLALEIYEFTHYIHEYGFTIQSSALGSAFYTLVGTHGAHVTFGLLWILSLMIRNAGRGLSLYNAPKFFVASLYWHFIDVVWVFIFTVVYLMGMVG

SEQ ID NO: 5810 - protein, 109 aa, Bacillus licheniformis
MVNNENRGNPKTDLAYRKKKNAEDMRYQVISFGLMIGLTIVAFLTVASDAGVWFTVPFILLLAVIQVAFQLYYFMHMSQRGHEAPTLFLYSGVLVAFVTVLAFVTLIWW

SEQ ID NO: 5811 - protein, 300 aa, Bacillus licheniformis
MLGSLEIFGFRALWSPYFLGAVVFITALYFFLMKRLGSEGERASRKEIGLFLTAMILLYASKGSPVDLLGHIMFSAHMAQMAVLYLIVPPLIILGIPPWFWKKVIFLPIVKPLFRFFSKPLIAIIVFNGLFSMYHIPLVFDFIKTDAVYHAAITVLIFIAAFFMWWPLVHKVEELPQMSGLLKLGYIMADGILLTPACALIMFSDTALYSTYSDPSAWAEAMKLCVPLDTLSGMTLTGPEMFSSMPVLEDQQLGAIVMKILQEIVYGTFLAIIFFGWARKERAKDEKDLEEESYSPSTVH

SEQ ID NO: 5812 - protein, 119 aa, Bacillus licheniformis
MKFEESGIEGLTADLNRLDDIMENEGFVRAGQWDYERVTYDRKFDMVEGRFYLRVFGYAIEGDVGARRAVIKLMTPLLGKYYYPHGVEYGEDEHFPPQLLKTSKTVLNSIKEKVSALEV

SEQ ID NO: 5813 - protein, 148 aa, Bacillus licheniformis
MTRVKDIMTKETLYCTVLDNVYEAAVKMKDGDVGAIPVVLDDGLELVGIVTDRDLVLRGIAAKKPNSQKITNVMTTDLITVSEDDSIEKAVDLMGDYQIRRVPVTRGKTLAGIITLGDVSTHNKSNRQAGDALTFISENEERPGDFLH

SEQ ID NO: 5814 - protein, 347 aa, Bacillus licheniformis
MKNILRAVVILLIVAASYTLFIQYGSTPEKIAKEDKPQVSNEDAKKEKPLNIPDSGLLSFIGESAETIEKKLGKPDRVDPSAYDYEWWVYNQGKKQYVQIGLLGGKAVTLFATGDGVNTAPFKIGRPSREVFKTTQIAPYVNVQYKGSSYRFEFSEEDMNTRPTVKVGDIYVQLYMDKFEGTLSSIRAFDAPTLIKQRPYEVVYRGTLIEPKALTESDWKKIEKANEKQIFDITNVIRARHGLSELTWDEGVSKVAYGHSSDMKEHHYFSHVSETEGTLKDRLEKGKVNFEQAGENIALNYVDGPAAVEGWLNSEGHRKALLNADYTHLGVGVDEKYYTQNFIKEWQ

SEQ ID NO: 5815 - protein, 131 aa, Bacillus licheniformis
MANQNAQSSINEFKQFIKRHPKLISEVRKQEKSWQEVYENWVLLGEDDSIWDPYREEASAEKEPDAGGKNDFISKMVTAVRKMDANQMNEQINKMSQSISSLQSLLSQFSGGSQKQQKQSGGEHPFSFRKD

SEQ ID NO: 5816 - protein, 79 aa, Bacillus licheniformis
MRKEVQEYVFADEERRRFIREQPVWYRKLSRNPNDLSAFHLDMMNFYEKTIPHRVNQLSGSIQMAQMMLQMFHAMRTQD

SEQ ID NO: 5817 - protein, 149 aa, Bacillus licheniformis
MFATMESLRLQNEAYDLANMILQSEAAEHYRKCYKRLREDEEAGRIIASFTKIKEQYEDVQRFGKYHPDYKEISKKMREIKRELDLHDTVAEFKKAETELQSILDEVSVEIGHAVSKHIKVPTGNPYFDNLSSCGGGCGSGGSCGCKVS

SEQ ID NO: 5818 - protein, 71 aa, Bacillus licheniformis
MLRKFGNVHYVSKRLKYVVVYCNMEDAERIIAKIRSYSFVKQVDLSYKPFLKMEFESKQDKAKEYDYKAGL

SEQ ID NO: 5819 - protein, 188 aa, Bacillus licheniformis
MRVISGTYKGRALKAVPGTSTRPTTDKVKESIFNMVGPYFEGGTGLDLYAGSGGLGIEALSRGFDRFIFVDRDFKAIQTVKGNLKTLGLEKCAEVYRNDAERALHALVKRGASFDAVFLDPPYREQKLEALLSIIDEADMLTERGFIVAEHAKEVMLPDAAGGLQLARQEIYGLTGVTIYRKRGNGDG

SEQ ID NO: 5820 - protein, 164 aa, Bacillus licheniformis
MASIAVCPGSFDPVTFGHLDIIRRGAKVFDKVYVCVLNNSSKKPLFTVEERCGLLREVTQDIPNVQVESFQGLLIDYAKSKQANVILRGLRAVSDFEYEMQGTSMNKVLDENIETFFMMTNNQYSFLSSSIVKEVAKYKGSVAELVPEAVEAALEKKFAKNERP

SEQ ID NO: 5821 - protein, 361 aa, Bacillus licheniformis
MDMSKVKTLMIAVLLLSFTAAVITHPQESFDASKSGLAMWWEVVFPSLLPFFILSELLIGFGVVRFVGLLLEPFMRPVFRVPGVGGFVLAMGMASGNPAGAKLTSRLRQERQISRVEAERLASFTNSSNPLFIFGAVAVGFFHNPSLGVVLAAAHYLGNFAVGLTMRTYGRKEENRTAVRKKLPVPSIKEALKALHQARLEEKRPLGKLLSDAVISSVQTLLMVGGFIILFSVFNNILSVMHITDILSHATRMILTALQLPGDFDKPLLSGLFEITLGSKLVSATDAALLQQAVIVSFILGFSGFCVQAQVAGILAETDIRFSRFLSLASSREFMQRSLFLFFGSLFTHRSILRRSRSSPF

SEQ ID NO: 5822 - protein, 340 aa, Bacillus licheniformis
MLKKRIIRIALLLVIIVAALSFVKLPYYITEPGEATELNPLIKVDNGYPEKGSFSLMTVKVGPANPLTYIWAKMRPYHEILPEENFKQEGESDQEYMKRQLQMMRDSQENAMIAAYKRAGKEVSYTFNGVYAMSVVSGMPAEGKIQVGDKIKKADGKSFRSAESFVRYIESKKAGDRVKIVVERDKEEKTYEMKLKTFKEDPKRAGLGVSLITDRNVKVKPEVDMDIENIGGPSAGLMMSMEIYNQLTKEDETKGHHIAGTGTIDDEGKVGPIGGISQKVVAADKAGADIFFAPNEGGKKGSNYEEAVKTAKDIKTDMKIVPVDTMDDAIHYLEDKVKNT

SEQ ID NO: 5823 - protein, 416 aa, Bacillus licheniformis
MKAVGLVVEYNPFHNGHLYHIKEAKSETRSEVAVAVMSGSFLQRGEPAIVSKWARTKMALASFADVVVELPYIFAVQKAETFAEGAVSILNELGCSSLFFGSEHGDIEAFLNTAAHTIEHEDRLNEEARKQIAFGLSYPQAMAKAFRSVTREGGNIVDLSKPNNILGFHYVKAIMQKQLSMKPETVKRRSSGYHDSTFPEADRIASATSIRKSIFETGSLADSRFYLPKTTVDELDEYARTFGMWHSPEDYFPFLKYSLHTMDTEELKGIYEVEEGLEHRVKKAIRKAGSFKEYMELLKTKRYTWTRLQRMNTHILTKTKKADVKRMLNETHPAYIRLLGMTKKGQAYLAEKKKSLSAPLITKTGSFSHPSLQLDIKAGQVYSAPLKEPVRTMLTEQEYSLSPIRYDEDSRIFLRK

SEQ ID NO: 5824 - protein, 171 aa, Bacillus licheniformis
MKWTIHQLNQMPKKDFEFDETVDLSELSQSSEIRSISPVRVKGRAEIRSKQAAFDFTISGEMILPCSRTLVDVRYPFSISTKELFIFHKTEEMEDEDIHIVEDDLIDLTPVVKEEILLEIPMQIFCESVQKEEGAPQEGKDWQVITEDDRKDRIDPRLAGLGKLLKQEDES

SEQ ID NO: 5825 - protein, 57 aa, Bacillus licheniformis
MAVPFRRTSKTKKRLRRTHFKLQVPGMVECPNCGEMKLSHRVCKACGSYKGKDVKSN

SEQ ID NO: 5826 - protein, 199 aa, Bacillus licheniformis
MTITRQDAWTQDEDILLAEVVLRHIREGGTQLSAFEEVGKALSRTAAACGFRWNSFVRKQYQSGIELAKKQRKELRKKIGIHSANLPGSVKTVSESKAENLTLDDVIEYLEKLKEAPVQKDFIDEKKKLAEEINELKQEVEKLRSENQSLKKKLELTEEDYKALIEIMERARKMVVLQGDERNKKAMLQPEPNENLGEA

SEQ ID NO: 5827 - protein, 159 aa, Bacillus licheniformis
MVKVERLLINYKTLEEFKKFREYGIQELSMLEDLESNMIENDSNSPFYGIYYGNRLVARMSLYKVDGKSNQYFEEGQDYLELWKLEVLPGYQRNGYGTMLVEFAKSFGLPIRTSPRVKSSDFWNKMGFTPVKYDMARDKGENPLVWHPASEPSQSSESA

SEQ ID NO: 5828 - protein, 293 aa, Bacillus licheniformis
MKIGVIGGGSVGLLFAYYFSFGHEVTVIARRKEQAEAIEEKGIRLLEDGKEMTVNARGVTELDPDCDLLFVAVKEHQLGAVLSELEQAAPLDIMFLQNGMAHIPVLEKWQTGHRIYTGSVEHGAVRVDDRTFRHTGKGAVKWSAFRSQSAARLKKELASVHEAFPFIWSEDWYKPLAEKLIVNACINPLTALLRVKNGALLEEPMYGAYMKFVFEEASRILELEDRQAAWDHVLSVCRRTKSNTSSMLADVLAERKTEADAIIGYLLKRAKESGEPAPHLTFLYRSIKALENE

SEQ ID NO: 5829 - protein, 497 aa, Bacillus licheniformis
MDDLSSRTYDRDALADYLLDYHRKFQSATMNETIERLRDPKSVVVVGGQQAGLLTGPLYTIHKIVSILLLAKQKEQELNVPVIPVFWVAGEDHDLEEINHVYISDGGKVKKHKLPQSHWKKSQAAKTALDAEKAEKWLDGIFASFEETEYTNDLLGHLRRCLRQSLSFTDFFEFLVADMFEQDGLILLNSGDPGIRNLEARFFRQLLDKNDELTDSVKRQQELMKQLGYTPIIEGAAQHANIFYERDGERFLIEKENGAFFIKELHLQWSEAELCDLICQNPEAFSNNVVTRPLMQEYLLPTLAFIAGPGEINYWGELKGAFQVMGYKMPPVVPRLQVTFLERHIEKKLDERGIELRESIEKGARAKKEQYFQDKVPSGFTDSVKQAKEKIENIHSAVRAEALEIDGSLGPLLEKNAGFIQDQLQFLEKTVIRRIEEKENYILRDFDKIQTSIKPLDAPQERIWNIVYYLNKYGPDFLEKYKDLPYSFQNMHQVVKL

SEQ ID NO: 5830 - protein, 154 aa, Bacillus licheniformis
MSWGTKVGAEIMFMGEYQHTIDSKGRMIVPAKFREGLGEQFVLTRGLDQCLFGYPMSEWKLIEEKLKALPLTKKDARAFTRFFFSGATECELDKQGRINIASPLLNYAKLEKECVVIGVSNRIELWSKEIWEQYVEEQEDSFAEIAENMIGFDI

SEQ ID NO: 5831 - protein, 312 aa, Bacillus licheniformis
MFEHTTVLLKETVDGLNVKEDGTYVDCTLGGAGHSEYLLSQLSEKGKLVAFDQDETALRHAKEKLADYEGQVVFIKSNFRYLKDRLNEIGITKVDGVLFDLGVSSPQLDTPERGFSYHHDAPLDMRMDQSAGLSAKEVVNEWPYEDLVKIFFKYGEEKFSKQIARKIEKAREQSPIETTGQLVDIIKEAIPAPARRSGGHPAKRIFQAIRIAVNDELRVFEEALLQAIEVLKPGGRVSVITFHSLEDRICKSTFKDMSSPPELPHGLPVIPKEFEPKLKLVNRKPITASEEELEHNNRARSAKLRIAEKARE

SEQ ID NO: 5832 - protein, 117 aa, Bacillus licheniformis
MSNLAYKVEKQQRQTDSAEQSVIIRRRASITLGEKVLIVLFALAVLSASLFMISKAFAAYQTNIEIQKLEKKVETESSRVDDLEKEADMLKEPDRIMDIARKKGLKLGDKKVKDIQE

SEQ ID NO: 5833 - protein, 711 aa, Bacillus licheniformis
MPKKNKFMNRGAAILSICFALFFFVIVGRFAFIQATGKVNGEVLAQKANEQYEKKRTIEAHRGSILDRNGKVLAEDATTYKLVAIMSEKMKPQYVKDKQLTAEKLAPILGMDEGKVLDILNKKGAFQVEFGSAGRDLTYAQKEKIEKLKLPGIVFTRDTKRYYPNGIFASNLIGYSQINEKTGEMQGMMGLEKTLNDYLKETDGYMTYDTDRTGWRLPNSNEKIKAPNNGDNVYLTIDQKIQAFLEDSMTTVQKEYKPKKIMAAVVDPKTGKVLAMGQRPSFNPNVRDVTNYYNDLVSYSFEPGSTMKIFTLAAAIQEGVYNGGEQYKSGSYSVSKKDKPIKDHNGGNGWGPITFNEGVERSSNVAFAILANDKLGTDRFNQYLRKFHFYDKTGIDLPGEANSKINFEYLRDKVSTAFGQSSAVTPIQQLQAATAIANNGKMMKPYVIDHVVDSDKNKTIYQNKPEQVGQPISAKTAKEVRELLGKVVTSEKGTGQPYKIEGFDVAGKTGTAQIAGEDGRYLTGRENYVFSFMGMAPKDDPQLLVYVAVQQPQLKATETGSAPVSKIFNPVMKNSLHYLNITPKETEKEEKQEEKQLKMPDFSGKRAESAAKEAQGSSLVPVTIGDGLAVKEQYPKAGEAVLPNQRVFLKTDGKITLPDMTGWSKRDALRFGAMAGIHIETSGQGYVKSQNVKAGKELKANSVVKVRLKNE

SEQ ID NO: 5834 - protein, 644 aa, Bacillus licheniformis
MRVSNVTVRKRLIFVLLFGVIIFLIIDTRLGYVQFVLGDKLTTLAKDSWSRNLPFEPERGEILDRNGVKLATNQSAPSVLVVPKQVENPIKTSRLLASVLNMSEEKAYKHVTKKTSIERINPEGRKISHEKAKEVRDLNLKGVYIAEDSIRHYPFGSYLSHVLGFAGIDNQGLLGLEAFYDKELKGEKGYVKFYSDAKGKRMPGEADDYTPPKDGLDMKLTIDSKVQTIMEREFDIAEAKYNPDGMVGVAMNPKNGEILAMVSRPDFDPANYQSIDPKVYNRNLPVWSTYEPGSTFKIITLAAALEENKVNLQKDQFYDKGSVEVDGARLKCWKRGGHGAQSFLEVVQNSCNPGFVELGQRLGKEKLFTYIKSFGFGQKTGIDLQGEGTGILFPLDRVGPVEQATTAFGQGVSVTPIQQVTAVSAAVNGGTLYTPYIAKEWIDPVTKQTVKKQTPIAKRKVISEETSKQIRYALESVVAQGTGRNAFVDGYRVGGKTGTAQKVKDGKYLKNNHIVSFIGTAPSDDPSIVVYVAVDNPKGTIQFGGTVAAPIVGNIMRDSLPQLGVKKRKDQIEREYQWLDKKLIEVPNLIGLSVTELEPLLINLRLKASGEGDVVVQQSPKPGEKVKEGSTIRIYLDSDDGASD

SEQ ID NO: 5835 - protein, 488 aa, Bacillus licheniformis
MKLTKLLTYLKNVPSYAGQEDPDITSIEMDSREVKTGSLFVCIKGYTVDGHDYARQAAEKGAAAIVAEREVDADVPVIIIRHTKRALAVLSDAFYGQPTKQLRLIGITGTNGKTSTSHMVEEIFRKAGSRTGLIGTMYTKIHDETFEAKNTTPESVTLQKTFRKMVDQGVDTAVMEVSSHALHMGRVHGCDYDIAAFTNLTQDHLDYHETMEEYKHAKSLLFSQLGGSFNHETPKWAVLNADDPASAYFAQVTSAHLLTYGIQNDADVMAENIKMAPKGTTFDLVTPKGSAQVTIPLVGLFNVYNVLTAAAIAIAADIPFATITEGIEGLKGVRGRFELVDAGQDFPVIVDYAHTPDSLENVLNTCRGLTEGKLFVVVGCGGDRDKTKRPKMAKIAVDLADEPVFTADNPRSENPLAILNDMEEGVKGAYYHSIVNREQAIFFAIANAKKGDVVLIAGKGHETYQQIGGQTFDFDDAEVAKRAILELK

SEQ ID NO: 5836 - protein, 324 aa, Bacillus licheniformis
MLEQVILFTIIMGFLISVLLSPIFIPFLRRLKFGQSIREEGPKSHQKKSGTPTMGGVMIILSIIATTIVMTMKFSEVSMNMILLLFVTVGYGLLGFLDDYIKVVMKRNLGLTSKQKLIGQIVIALVFYAVYHFQGMPTDIRIPGTELSFDFGWIYPVLVIFMLVGGSNAVNLTDGLDGLLSGTAAIAFGAFAILAWNQSQYDVAIFAVAVVGAVLGFLVFNAHPAKVFMGDTGSLALGGAIVTIAILTKLEILLVIIGGVFVIETLSVILQVISFKTTGKRIFKMSPLHHHYELVGWSEWRVVVTFWTAGLLLAVLGIYIEVWL

SEQ ID NO: 5837 - protein, 451 aa, Bacillus licheniformis
MDTQDLLQNQNVLVLGLAKSGYAAASILHEKGVKVVVNDQLPFEENEPARILAEKGVEVVCGSHPTELFDLHSIDILIKNPGIRYENVMVEEALKRGIPVWTEVELAYHLTDAPFIGITGSNGKTTTTTLVYEMLKADSKKALVAGNIGTAASEVANQASGDEWIVTELSSFQLMGTYQFRPKIGLLLNVFDAHLDYHHSRKNYELAKQQVYRNQSETDVAVVNLDDETVVRLAECSKAEKVYFSVRRTLERGACVKDGAIMFNGEPVMPLEDVVLPGEHNLENILAALCIVKTAGVSDAAVRKVLTSFTGVKHRMQYVATIKNRLFYNDSKATNILATKKALSAFQKPVILLAGGLDRGNEFDELKPHMSFVKAVITFGETAPKFEKLAEEMGIQQVKRVDNVEQAATAAFSLSDEGDVILLSPACASWDQYKTFEERGDMFVNAVHMLK

SEQ ID NO: 5838 - protein, 366 aa, Bacillus licheniformis
MQTKKTSPDFLLVIITLLLLTIGLIMVYSASAVWATYKYDDSFFFAKRQLLFAGIGVIAMFFIMNVDYWTWRTYAKILIIVCFFLLIIVLVPGIGMERNGSRSWIGVGAFSIQPSEFMKLAMIAFLAKFLSEKQKNITSFRKGFVPALGIVFSAFLIIMMQPDLGTGTVMVGTCIIMIFVAGARISHFVFLGLIGLSGFVGLVLSAPYRIKRITSYLNPWEDPLGSGFQIIQSLYAVGPGGLFGLGLGQSRQKFFYLPEPQTDFIFAILSEELGFIGGSLILLLFSVLLWRGIRIALGAPDLYGSFVAVGVISMIAIQVMINIGVVTGLIPVTGITLPFLSYGGSSLTLMLMAVGVLLNVSRYSRY

SEQ ID NO: 5839 - protein, 366 aa, Bacillus licheniformis
MRIVVSGGGTGGHIYPALAFIKEVKRHHEDVEFLYIGTEKGLEKNIVEREGIPFKAIEITGFKRKLSFENVKTVMRFLKGVKECKEELKRFKPDAVIGTGGYVCGPVVYAASKLGIPTIIHEQNSLPGLTNKFLSKYVDKVAICFDEAKTHFPAEKVVFTGNPRASEVVSIKGGRSLTALGLAEGKKTVLIFGGSRGAAPINEAVIAMQNELKKRDYQVLYVTGEVHYDKVTAALEKEGAAPNMVVQPFLHQMPEYLKAFDVVVGRAGATTIAEITALGIPSVLIPSPYVTANHQEVNARSLGEQNAAVVLKESELNGDRLIQAIDHILQDEKTLEEMKIRAKSLGVPDAAERLYNVLKELKHHAK

SEQ ID NO: 5840 - protein, 303 aa, Bacillus licheniformis
MDKVIQELKELEVGKVLENEPLSNHTTIKIGGPADVLVIPKDIQAVKDTMKVVKKHGVKWTAIGRGSNLLVLDEGIRGVVIKLGQGLDHMEIDGEQVTVGGGYSVVRLATGISKKGLSGLEFAAGIPGSVGGAVYMNAGAHGSDISKVLVKALILFEDGTIEWLTNEEMAFSYRTSILQNKRPGICLEAVLQLEQKERDQIVAQMQKNKDYRKETQPVSNPCAGSIFRNPLPEHAGRLVEEAGLKGHQIGGAKVSEMHGNFIVNAGGATAKDVLDLIAFIQKTIKEKYDIDMHTEVEIIGEKR

SEQ ID NO: 5841 - protein, 262 aa, Bacillus licheniformis
MKPGIDKEKVVNIEERIPKIKEQRKQKANRRLITFILLFFTMMLIIIYLQTPISKVSKVEIKGNKNVSKEQIISLSSIHKGQTEFWSLSKQKAAEKIEQNKLIKKAEISKQLPNKIAISIEEYKSIAFLQKHNVYYSVLENGTVLPEEVTPTDIGPTLNNWEEDEKLVQMAKQLNKLSDSVKKSISEINYTPQKSNPWLIKLYMNDGYIVTASLKTFGQKMNSYPAIVKELPKGEKGIIHMEVATYFEPLKKTDESKKGDGN

SEQ ID NO: 5842 - protein, 230 aa, Bacillus licheniformis
MKRHTVNLSLAMLVLGFLLSFSYQFARENKDHEETAENWKEEYSLRDRLISQEKQNKKLEQELYKKQQEVQKTETALKKEKKEYYNIVEDVERYRMFVGEIGVQGEGIKVTLKDASYIPEGENVNNYIVHESHIFRLLNELWISGAAAVSINGQRVTHHSYISCNGPVITVDGNQYPAPFVISAIGDADVLMPALNIAGGLVDQLSRDHISVSIEKQDNIEMEPLLKQGE

SEQ ID NO: 5843 - protein, 229 aa, Bacillus licheniformis
MKKNNRFISLSILMLIFGIMLSVQFNSLKAPKVRDTRDIWDLREDLKEEQKKQLDLISEIDKYEKMLNTYSHQEETSRTKALNETLQNLKKQAGFTDVTGNGIIITISQLFSEELTGESIQNPPPDLLKKLINELNMYEAEEISINDRRVVNTTVIRDINGTTKIDGYPLDNYPITVKVIGKNADKLYSRMNASSLQDLFAGENLDLQIKRPEKQSKSKLTKVQCKLRH

SEQ ID NO: 5844 - protein, 117 aa, Bacillus licheniformis
MASGFRGFCSEITIGFSTNFTIPDEYSNYLSLAILASLDTLIGGIRAHLESVYDELVFVTGFFFNIILAISLAFLGVHLGVDLYLVGMFAFGVRLFQNIAVIRRILLAKWTASRRKN

SEQ ID NO: 5845 - protein, 432 aa, Bacillus licheniformis
MNNNELYVSLDIGTSNIKVIVGEMSDDSLNIIGVGNVPSEGLKKGSIVDIDETVHSIKKAFEQAERMIGFPLTHAIVGVNGNYIHIQDTNGVVAVSSENKEIHVEDVRRVMEAAQVVSIPPEQLIVDVIPRQFIVDGRGDITDPKKMLGVRLEVEGSLITGSKTILHNLLRCVERAGIEITDICLQPLAAGSVALSKDEKNLGVALIDIGGGSTTVAVFEDGHLLATRVIPLGGENITKDISIGLRTSTDEAERVKKQFGHAFYEEASEEETFEVAVIGTDQKQTFTQREVADIIEARLEEIFLFVAEELRNMGIKELPGGFVLTGGQAGMPGVLSLAQDVLQNNVRVASPNYIGVREPQYMTGVGLIQFAYRNAKIQGRKVGFKMPEQAVQEVAATHQKEVQQRPKPKSKQQAQAEKKPSKMKKIFNIFWE

SEQ ID NO: 5846 - protein, 377 aa, Bacillus licheniformis
MLEFETNIDGLASIKVIGVGGGGNNAVNRMIENDVQGVEFIAVNTDAQALNLSKAETKMQIGAKLTRGLGAGANPEVGKKAAEESKEQIEEALKGADMVFVTAGMGGGTGTGAAPVIAQIAKDLGALTVGVVTRPFTFEGRKRQLQAAGGISAMKEAVDTLIVIPNDRLLEIVDKNTPMLEAFREADNVLRQGVQGISDLIATPGLINLDFADVKTIMSNKGSALMGIGVATGENRAAEAAKKAVSSPLLETAIDGAQGVLMNITGGTNLSLYEVQEAADIVAAASDQDVNMIFGSVINENLKDEIVVTVIATGFIEQDQDSSKPQRPLNQGLKQHHQPAPKREPKREEPSMPHRSPSQPAEDTLDIPTFLRNRNKR

SEQ ID NO: 5847 - protein, 502 aa, Bacillus licheniformis
MKKKPLFRTFMCAALIGSLLAPVAVQADTGTAAKTKEQSKISSALYKRFEKEGKVTFLIKMKSQANLQQAATAAEKRAKASVMTVKKAKEIKRSAVLTSLRTKAERTQKDLKSFLEKEEKKGTAKKVESFYIVNGIAVTATKDVMEKAASFPEVEKVLPNQKIKLGNTEKPTVESKTTADRTPASNIEQVHAPDVWKKRYKGKGAVVASIDTGVEWDHPALKTKYRGYNPSKPNSPDNEFNWFDAVSNKKTPYDELGHGTHVTGTMVGSEAGGKNQIGVAPTAKWIAVKAFSEDGGDEKSLLAAGEWILAPKDAKGKAHPEKAPDVVNNSWAGERGLDEWYLDIVKAWRAADIFPAFAAGNVSEFEPGGPGSVENPSNYPQSFAIGAVDSSNALADFSLQGPSPYDEIKPDISAPGVSIRSAYPGHKYAAMNGTSMATPHVSGIVALMREANPDLTVDEIERILLKTATPLTDKTFKKSPNNGYGYGLVNALKAFDAAKKTK

SEQ ID NO: 5848 - protein, 1432 aa, Bacillus licheniformis
MKRKLRKKAFSTILSGLLIGSLFMPAVSDAAAKPALTSMKEQAAAGKGKISKTLVKQFKKEDQVTFLIKLKDQVDTPKVAKQAEKNAKKKSLSAAKTEYQKRSAVVSALRVKADESQSDLKRYLKKQEKQGDVKKIRSYYIVNGMAVHATKEVMEQVAAFPEVEKVLPNEKRQLIKPTKQSVKKSAAKDEKEIEWNINRVDAPKAWKLGYDGSGTVVASIDTGVQWDHPALKEKYRGYDPQHPDQPNHEFSWYDAVSGASEPFDDLEHGTHVTGTMVGSEPDGQNQIGVAPGAKWIAVKAFSDDGGTDEDLIAAGEWILAPKDKDGNPHPEMAPDVVNNSWSGGAGIDEFYRDIVKAWRAAGIFPEFSAGNVDFANPGGPASIANPANYPEAFATGATDIDNRLADFSLQGPSPYDETKPEISAPGVNIRSSVPGSGYQDGWDGTSMAGPHVAAAAALIKQADSSITVDETEKILMETATPLTDSKFTESPNNGYGHGLVNVFDAVSAVTDGLGRAEGQVGKEGEDKSPPALNHQEITEIYSGSETPLKADVEDDVSIISVKLSYKTDDADWETIAAKQTSGDYKKGTYEAAVTVSEGKTLSYKWIVTDFGGNKTESKVYEVPISPAVTTGYKQDFENSASGWLTSGVKNSWERGIPQSGPNAAASGKNVFATNLTGPYESSANMNLLMPPVSVPKNQKLYLTYKYWRDIEEDFDYGFVYVQPEGKGEWIPAAEYSGKTSEWKDGQIDLSEYGGQTIKVMFNLQSDDSIEGDGLYIDDVALVKEVKSAGTKKRLGVEKQPAKMKDKKTKKRMIDPKKAKPAEALQEKTETKKAAPAVLPVRAQVSVLETGKSTYSNQATGAYSLAHAPGTYTLKAEAYGYESTAQTVKIESDKTTTADFVLKELKKGTLTGTIKNKKTGEPVRHAKLYIVEDAAVKPVQTDDDGSYSLTAYEGSYTVKVSANGYYSSEFSVDLKGDVSKDIDLDPFIGYPGEIGYDDGTGENAWAFYESGNGLAVKMTLENGQEKAMLKGGLFKFWDTEFPDPGGTDFAVEVYDASGEKGSPGKKIAGPFKAEALRTGEWTTVDLGDEGIIVGKDFYLVYVQKEDLANSPGLATDEDGEYSGRNWQYTDGSWSKAPSDQGNFMIRALVDYELSVPVITSPKDGFITNQKNAVIEGTSSPNTTVHLFNGDEEAGTAETAADGTFSKEIPLNKGENVITAKSSSASGTTDASEPVRIVLDQKKPKLTIDTPESGSKLNKETVTVKGTVSDDHLESVHVNGKKAAVDNGEYSARIMLDNGKNEIKVTASDAAGNKTTKKVTVDVNFEAPQITGLKPAEDLELKTGETVKIEFESAADLDAVFVIRMPLTNFKTAAQNVTELPIREVSKGKYEGYWTATSTAKAKGAEIEVIVRDDYGNETRQTAKGKLYINEKLK

SEQ ID NO: 5849 - protein, 309 aa, Bacillus licheniformis
MEIYLDAIWLLNFCFDLLLLMMTAFILKRRVKKRRLILGAFVASSIVLFMFTPFSPYVLHPAGKLSFSVVIVLVAFGFKRFRFFLQNLFSFYFATFLMGGGIIGAHSLLETDSIMENGVFMTNWSGFGDPVSWLFVCVGFAAVWLFSKKRFEDAEAKKIQYEERVRLEACIGEHTLHFTGLIDSGNQLYDPITKTPVMIVNIEKLKVVLGEEASVTIKEMSPLDAVGKLDEALPYIGRIRLIPYRGVGHQHQFLLCLKPDHVLVCTEREVIEAPKCLIGISTSPLSADGEFDAIVHPKMLAGNPVKHVS

SEQ ID NO: 5850 - protein, 239 aa, Bacillus licheniformis
MKKLKLRLTYLWYKLLMKLGLKSDEIYYIGGSEALPPPLSKDEEQVLLHKLPDGDQAARAILIERNLRLVVYIARKFENTGINIEDLISIGTIGLIKAVNTFNPEKKIKLATYASRCIENEILMYLRRNNKIRSEVSFDEPLNIDWDGNELLLSDVLGTENDIITKDIEANVDKKLLKKALEQLNDREKQIMELRFGLVGGEEKTQKDVADMLGISQSYISRLEKRIIKRLRKEFNKMV

SEQ ID NO: 5851 - protein, 259 aa, Bacillus licheniformis
MSRNKVEICGVDTSKLPVLKNEEMRKLFKQMQDEGDTTAREKLVNGNLRLVLSVIQRFNNRGEYVDDLFQVGCIGLMKSIDNFDLSHNVKFSTYAVPMIIGEIRRYLRDNNPIRVSRSLRDIAYKALQVRERLISETSREPTAQEIAKELEVSHEEIVFALDAIQDPVSLFEPIYNDGGDPIYVMDQISDERNKDSQWIEELALKEGMRRLNEREKMILRKRFFQGKTQMEVADEIGISQAQVSRLEKAAIKQMNKNIH

SEQ ID NO: 5852 - protein, 265 aa, Bacillus licheniformis
MVLQLEHASLKRNGEWILKDIDWTVEKGEHWALYGLNGAGKTALLNMLCAYYFPTIGKVTVLGREFGKTELGEKLRRKIGLVSAALQQKLYPEDSAFEIVLSGAFASIGLYESPSQSVREKAVALLEEFGSIRYADRRYETLSQGEKQKVLIARALMADPELLILDEPVTGLDFIAREQVLDTVEQIAKKDSAPSMLYVTHHAEEILPAFSQTLLLKKGEVFALGKTREMMSGEVLSEFFDMPVQAVWTEDRPYLSKKKTANLNV

SEQ ID NO: 5853 - protein, 53 aa, Bacillus licheniformis
MFQCPLCAANMAISELKSLICSNRHTFDIAKGGYVNVATHSPSVKIYLKPEEC

SEQ ID NO: 5854 - protein, 79 aa, Bacillus licheniformis
MDMMNISDFQIKDVVNVSNGKKLGSIGDIDINVTTGKIQAIVIGGTGKVFGFFGKEEEIVIPWRNIVKIGEDVILVRLS

SEQ ID NO: 5855 - protein, 287 aa, Bacillus licheniformis
MFVERLITMNTYNPFRLDAPSMLLIEEWNQTAETGGAVTAGFTTKNGGESEPPFHSLNTGLHVQDHEQHVINNRKKVADILKTDLHDWVFADQTHEDRIHKVTDGDRASGAFRYDTALKATDGLYTDRPNLFLALCFADCVPVYFYDPVRSLVGIAHAGWKGTALGIAASMVDMWIRREGSNPADIRAVIGPAIGSCCYTVDDHVIDKIRNLPLQQEDKAFLTIKEGEYRLELKEVNRQLLVHAGIPNGQIEVSSLCTSCERSLFFSHRRDRGKTGRMMSFIGLKEV

SEQ ID NO: 5856 - protein, 179 aa, Bacillus licheniformis
MGENRDTGLLHKLDVLKDSEPVWHFIGTLQTRKVKAIIDHVSYIHSLDRLSLADEIQKRAKKPIDCFVQVNTSLEPSKHGMAKEEVLPFVKKLSGYENIRIAGLMTMAPFTDDEKAIRSCFRLLRELRDEVRGLDQWNAPCSELSMGMSNDYAIAVEEGATFVRIGSSLVGNETGGGQS

SEQ ID NO: 5857 - protein, 150 aa, Bacillus licheniformis
MSLKNKFKNFFSLDDEEYEYEYIETDREEIPEEHESKDRTAYQSKAAGKQNVVSLQSVQKSSKVVLSEPRVYAEAQEIADHIKNRRAVVVNLQRIQHDQAKRIVDFLSGTVYALGGDIQRIGADIFLCTPENVDVSGTISELIEEEHQRW

SEQ ID NO: 5858 - protein, 89 aa, Bacillus licheniformis
MILLYQILSTLLTVYSFALIIYIFMSWVPNARESSFGRVLASLCEPYLEPFRRIIPPLGMIDISPIVAIFVLKFADAGLLAVFRMLGAF

SEQ ID NO: 5859 - protein, 258 aa, Bacillus licheniformis
MSDIYQHFRKDEEPFIDQALEWKRIVAEQYRMKLTDFLDPREQVILQSVIGQSDEVRLEFFGGFPEAERKRAVLFPEYAEPSAEDFQLQAWEVIYPQKFASIEHRELLGSLMGIGLKRQKFGDLIFSDGTWQFICSEEVADFVFTQLTQIGKVKVSLEKIPLSKLKVPEQDVEIRDDTVSSLRLDAICSAMSRQSRQKAQVLVKNGLVKVNWKVIEDPSYALAEGDMVSIRGFGRFRMKNIDGKTKKGKWRLTFEKQK

SEQ ID NO: 5860 - protein, 164 aa, Bacillus licheniformis
MPLTPNDIHNKTFTKAFRGYDEDEVNEFLAQVRKDYEIILRKKNELETKVNELDERLGHFSTIEETLNKSILVAQEAAEDVKRNSEKEAKLIIREAEKNADRIINESLSKSRKIAMEIEELKKQSKVFRTRFQMLIEAQLDLLKNDDWDHLLEYEVDAVMDEKE

SEQ ID NO: 5861 - protein, 922 aa, Bacillus licheniformis
MDYKDTLLMPKTDFPMRGNLPNREPEIQGKWEDMDIYSLVQKRTEGRPMFVLHDGPPYANGDIHMGHALNKVLKDFIVRSRSMSGYHAPYVPGWDTHGLPIETALTKNKKVKRKEMTVAEFRKLCEEYAWQQIEGQKAQFKRLGVRGDWENPYVTLKPEFEAQQIKVFGEMAKKGYIYKGKKPVYWSPSSESALAEAEIEYHDKRSPSIYVAFDVKDGKGVLTNGEKIVIWTTTPWTIPANLGIAVHPELEYSVVAAGGARYVMASALIESVAKAIGFEDHEVVQTVKGKDLEHIVAVHPLYGRDSLVMLGEHVTTDAGTGCVHTAPGHGEDDFIIGQKYGLDVLCPVDEKGHMTSEAPGFEGLFYDQANKPITEQLEEKGALLKLDFITHSYPHDWRTKKPTIFRATAQWFASIKDFRDELLEAVKKTKWVPEWGETRLYNMIRDRGDWCISRQRAWGVPIPVFYAENGEPIITDETINHVSELFREHGSNIWFEKEANELLPEGFTHPGSPNGKFTKEQDIMDVWFDSGSSHQAVLEEREDLVRPADLYLEGSDQYRGWFNSSISTAVAVTGKAPYKGVLSHGFALDGEGRKMSKSLGNVVVPAKIMNQFGADILRLWVASVDYQADVRVSDAILKQVAEVYRKIRNTFRFLHGNIADFDPAKDAIAVEDLREVDQYILIKLNSLIEKVKKAYEEYDFAVIYHAVHNFCAIELSSFYMDFAKDVVYIEHADHKDRRSMQTVFYETLLALVKLIAPILPHTADEMWSHFTFVSEKSVQLTDMPETRDIPNAKETEEKFDSFMKLRDDVLKALETARNEKIIGKSSVASLTLYPNEEAKALLSSIKEDVKQLFIVSELAIGGTEADAPEDAQSFETGKIVVAQAEGETCERCRMVSKEIGEDPDHPELCPRCAGIVKTYYQN

SEQ ID NO: 5862 - protein, 121 aa, Bacillus licheniformis
MNEQLAAIHTELLQMKEELEARLFEYSFFQQDSQGISSYQQATLMYHVKEELQDVLLALSKIENGTYGICEETNQAIPLAKMTILPTARTANDFLYHAQFEKKTLPIWAETDETFNRALYS

SEQ ID NO: 5863 - protein, 153 aa, Bacillus licheniformis
MPYYIIALLIIGIDQFTKWLVVSKMEYGESIPVIDGFFQITSHRNTGAAWGILAGQMWFFYIITTVVIIGIVYYIQKHAKGQILLGIALGLMLGGAVGNFIDRVFRQEVVDFIHVTIVNYHYPIFNIADSSLCIGVLLLFIQMLLDGKKKKEL

SEQ ID NO: 5864 - protein, 304 aa, Bacillus licheniformis
MEHYDMTVHEEHKGERIDKYLTAVEADWSRTQVQQWIKEDRVLVNGNAVKANYKVQEGDAVSVQVPEPEPLDVTAEPMDLDIYYEDQDVLVVNKPRGMVVHPAPGHLTGTLVNGLMAHCDDLSGINGVMRPGIVHRIDKDTSGLLMVAKNDMAHESLVNQLVNKTVTRKYTALVHGVIPHDHGTIDAPIGRDKKDRQSMTVTRENGKHAVTHFEVIERFDDFTVVECQLETGRTHQIRVHMKYIGFPLAGDPKYGPKKTVDFNGQVLHAGVLGFDHPRTGEYVEFEAPLPDDMKNLLDKIRNKR

SEQ ID NO: 5865 - protein, 182 aa, Bacillus licheniformis
MQEQEKAVVLDEQAIRRALTRIAHEMIERNKGMNNCILVGIKTRGIYLAKRLAERIEQIEGNKVTVGELDITLYRDDLSKKTSNKEPLVKGADIPADITDQKVILVDDVLYTGRTVRAAMDALVDVGRPSSIQLAVLVDRGHRELPIRADFIGKNIPTSKTEKVMVQLEEVDGRDLAAIYKK

SEQ ID NO: 5866 - protein, 434 aa, Bacillus licheniformis
MSQKKVNLGVREVPKPLNWISFSLQHLFAMFGATILVPKLVGLSPGVALITSGLGTLAYLLITKGQIPAYLGSSFAFIAPIIAAKAAGGPGAAMIGAFMAGIAYGLIALLIQQLGTDWLMRLLPPVVVGPVIIVIGLGLASTAVNMAMYEDSGAKVLVYSAKHFGVAGFTLALTIICAIFLRGFFSLIPVLIGIIGGYLFALTQGIVDFQMVLDAKWFAVPDFVLPFVDYTPSAAAVGIGIAMVPVAFVTMSEHIGHQMVLSKVVGQDFIKKPGLHRSIFGDSVATMLASCIGGPPTTTYGENIGVLAITRVFSVFVIGGAAVIALCFGFIGKISALISSVPSAVMGGVSFLLFGIIASSGLRMLIDNKIDLENKRNLIISSVILVIGVGGAFIKISGFELSSMALAAIVGVVLNLVLPESKGDQDGIEIEEHI

SEQ ID NO: 5867 - protein, 306 aa, Bacillus licheniformis
MKHLTAMNELSLEDIHELIEEARELKKGKSDSVLSGKFAANLFFEPSTRTRFSFEVAEKKLGMNVLNLDGVSTSVQKGESLYDTVKTLESIGADVCVIRHSHDHYYDELIGHVGIPVINAGDGCGQHPTQSLLDLMTIHEEWGRFAGLTVSIHGDIKHSRVARSNAEVLTRLGAKVLFSGPDEWRDEDNPYGTYVSPDEAVAHSDVVMLLRIQHERHEKKAAERDYLETFGLSLKRAELLKKDAVIMHPAPVNRGVEIDSALVESGRSRIFKQMENGVYIRMAVLKRALLNGENKKRGDQAYVLFN

SEQ ID NO: 5868 - protein, 428 aa, Bacillus licheniformis
MSYLIKNGFMLDEKGEKVQRDIRVEGDAISEIGSLEAASGETVIDADGLFVSPGLVDLHVHFREPGGEKKETIETGAKAAARGGFTTVAAMPNTRPVPDTKEQMEWLVNRIDETASVRVLPYASITIRQTGREMTDFEGLKDAGAFAFTDDGVGVQTAGMMYEAMKKAASINKAIVAHCEDNSLIYGGSVHDGEFAKANGLNGIPSVCEAVHIARDVLLAEAAGCHYHVCHISTKESVRVVRDAKKAGIRVTAEVTPHHLLLSDSDIPGLDTNYKMNPPLRSPEDREALLEGLRDGTIDFIATDHAPHTEEEKQQTMSLAPFGIVGLETAFPLLYTHFVKTGKWTLKQLHDYMTVKPCEAFGLPYGKLEAGRSADITLIDLEREEKIDKSTFLSKGKNTPFDGISCFGWPAMTMAKGKLVYQEGRLVK

SEQ ID NO: 5869 - protein, 364 aa, Bacillus licheniformis
MKRRLILENGTIFEGEAFGSLENTMGEVVFNTGMTGYQEILSDPSYCGQIVTLTYPLIGNYGINRDDFESITPYVKGFIVKELCQLPSNWRSAYTLDEYLKMKNIPGLSGIDTRKLTRMIRTAGTLKGVFAGPEEDAGALVQKLKETNLPTDQVSQVSTKTAYPSPGRGKRIVLVDFGMKHGILRELNKRKCDVIVVPHNITAEEVMQLKPDGVMLSNGPGDPTDVPEAIAMIQNILGKVPLFGICLGHQLFALACGAKTEKMKFGHRGSNHPVKELETGRVSITAQNHGYTVSSVENTPLEVTHVAINDDTIEGLKHKHEPAFTVQYHPEASPGPEDANHLFDQFLDMIETTEKEGEAVCLNA

SEQ ID NO: 5870 - protein, 1070 aa, Bacillus licheniformis
MPKRVDIKKILVIGSGPIIIGQAAEFDYAGTQACLALKEEGYEVILVNSNPATIMTDTEMADRVYIEPLTLEFLTRIIRKERPDAILPTLGGQTGLNLAVELSEHGILAECGVEVLGTKLSAIQKAEDRDLFRSLMNELNEPVPESEIIHSLGEAREFVERIGFPVIVRPAYTLGGTGGGICSNEDELKEIVENGLKMSPVHQCLLEKSIAGYKEIEYEVMRDSSDHAIVVCNMENIDPVGIHTGDSIVVAPSQTLSDREYQMLRNVSLKIIRALEIEGGCNVQLALDPDSFQYYIIEVNPRVSRSSALASKATGYPIAKLAAKIAVGLSLDEMMNPVTGKTYASFEPALDYVVSKIPRWPFDKFESANRRLGTQMKATGEVMAIGRTWEESLLKAVRSLEADVYHLELKDAGEISNEVLEKRIKKAGDERLFYLAEAFRRGYTVSDLHEFSAIDLFFLHKLEGIIRFEEKLKAGRGDLGLLKEAKELGFSDRFISLLWEMPERKLYDLRKEAGITPVYKMVDTCAAEFESETPYFYSTYEEENESVRTDKNSVIVLGSGPIRIGQGVEFDYATVHSVWAIKEAGYEAIIINNNPETVSTDFSISDKLYFEPLTVEDVMHIIDLEQPKGVVVQFGGQTAINLADELAERGVAILGTSLEDLDRAEDRDKFEQTLEMLQVPQPLGKTATSVEGAVEIAANIGYPVLVRPSYVLGGRAMEIVYHEAELLHYMENAVKINPQHPVLIDKYLTGKEIEVDAISDGETVVIPGIMEHIERAGVHSGDSIAVYPPQSLSEDIKKKLEAYTIKLAKGLNIVGLLNIQFVLSKDEVYVLEVNPRSSRTVPFLSKITGIPMANLATKVILGGKLADMGYTEGLQKEQEGVYVKVPVFSFAKLRRVDITLGPEMKSTGEVMGKDSTLEKALYKGLIASGIQIPNYGSVLLTVADKDKEEGLLIAKRFHAIGYKILATEGTAGYLRDASVPVKTVGKIGEEGTNLLDVIRNGEAQFVVNTLTKGKQPARDGFRIRRESVENGVACLTSLDTAEAILRVLESMSFRADHMPAIKIAQKAAVR

SEQ ID NO: 5871 - protein, 256 aa, Bacillus licheniformis
MRKGYMTVRSNKCIADHIYQMVLEGEIAEVCGAPGQFLHIKVSDSLTPLLRRPISIADINKAARQVTIIFRKDGEGTRLLSLKQEGDQLDVLGPLGNGFPAESLEQGKTALLVGGGIGVPPLYELSKQLTNRGVHAIHVLGFASAKDVFYEQEFSRFGRVYVATADGTRGSKGFVTDVIENEGLQFDCIMACGPTPMLKALKQRYPDKEVYLSMEERMGCGIGACFACVCHTEESETSYVKVCLDGPVFKAQEVLL

SEQ ID NO: 5872 - protein, 311 aa, Bacillus licheniformis
MLEINLPGLQLKNPIMPASGCFGFGREFANFYDLSRLGAIMIKATTSEPRFGNPTPRVAETQAGMLNAIGLQNPGLKAVMERELPWLEQFDTPIIANVAGSQIEDYVEVAEEISKAPNVHALELNISCPNVKTGGIAFGTQPEMAGELTKAVKEVASVPVYVKLSPNVANITDIALAIEEAGADGLTMINTLIGMRLDLKTGKPILANKTGGLSGPAVKPVAIRMVHEVSQKVSIPIIGMGGVQSAEDVLEFLLAGASAVAVGTANFVNPFACPDIIDDLPRVLEKYGYRSLNECIGRSWKDEQYAAHHRA

SEQ ID NO: 5873 - protein, 239 aa, Bacillus licheniformis
MNNTPPIIALDFASAQETYAFLDRFQGEELFVKVGMELFYQEGPAILENLQERGCRIFLDLKCHDIPTTVYKAMKRLAGFGVSLVNVHAAGGKQMMESALEGLEAGTPAGQKRPSLIAVTQLTSTSSEMLQRELLIETPLLDTVVHYSRLAEESGLDGVVCSVHEAEHIYRAVSVDFLTVTPGIRMADDKNNDQVRVATPGYAREKGVSAIVVGRSITQAEDPVSAYRRIGHEWEGTKA

SEQ ID NO: 5874 - protein, 209 aa, Bacillus licheniformis
MKTDIANHLLKIKAVFLRPNEPFTWASGILSPIYCDNRLTLSYPEVRDDIASGLAGLIQDKFPGAEMIAGTATAGIPHAALAADRLSLPMCYVRSKPKAHGKGNQIEGAVVKGQKVVVIEDLISTGGSVLEAAAALTEAGCEVLGVAAIFTYGLPKAAAAFSEAGVEYHTLTDYDTLTEAALAGGYITEQDAAKLKEWKADPESKSWMN

SEQ ID NO: 5875 - protein, 47 aa, Bacillus licheniformis
MKTDEQLEKVIIKMKDMLKDMNYGSITFVVQDGKVIQIEKNEKIRLK

SEQ ID NO: 5876 - protein, 176 aa, Bacillus licheniformis
MKKDAVIVFLDTGLHFKETYETIDAVKERYPGLQIIMKKPELTVEEQAKEYGDELWKTAPNSCCEMRKVIPLRETLSGYPAWLSGLRREQSPGRSKTNFLNKDEKFKSIKVCPLIHWTWKDIWRYVTKHDLPYNPLHDQGYPSIGCAPCTSPAFTMDDLRSGRWNGSAKTECGLHE

SEQ ID NO: 5877 - protein, 354 aa, Bacillus licheniformis
MELAAILFSMFFAMNIGASGAAASMGIAYGSEAVKKKFHALLICAAGVLSGAVIGGGNVVKTISSGIIPERVISLEIVCIIIGSAALSLFIANVLGIPLSTSEVTVGSVVGVGVAYQVLYVKSLLVIVSFWVIVPIVAFAFTFAMAKIMKKTIKRPASGKKAKVLAVILLITGFFEAFSAGMNNVANAVGPLVAAHVLTVGEGTLYGGLFVALGALLLGRRVLETNGKKITRFSKGEGIILSGTGAGLVITSSIFGLPVPLAQVTSSSIIGMGMAKNGGNVFHKQVVKTMLKVWVVSPFLSLSLSYMLVSLLLKGDYYALIVVTSVLLASVGTISLMRAVKKEHSSVHEQGGGI

SEQ ID NO: 5878 - protein, 378 aa, Bacillus licheniformis
MSLAPHGGVLVNRVNEAYDFQHIAHEIELDVMAFSDLELIGIGAYSPLQGFMTEKDYLSVFENMRLSSGEVWTLPITLPVDEQKALSLKAGDTVRLTYNGETYGVIEIEDIYTPDKKTEAVNIYKTDELEHPGVKKLFDRGSVYVGGPITLIKRSVKQFPAHTFEPLETRKKFAELGWKTIVGFQTRNPVHRAHEYIQKTALETVDGLFLNPLVGETKSDDIPADVRMESYQVLLDGYYPKDRVFLGVFPAAMRYAGPKEAIFHALVRKNYGCTHFIVGRDHAGVGDYYGTYEAQELFDQFAPEEIGITPLKFEHSFYCNVCGSMATAKTCPHGKEHHVILSGTKVRAMLRSGEFPPSTFSRPEVIQTLIKGLAAGVS

SEQ ID NO: 5879 - protein, 197 aa, Bacillus licheniformis
MVNKDIVWHEASITKREYHEKNQHKSSIIWLTGLSGSGKSTIANAAARELFAQGYQVTVLDGDNVRHGLNKDLGFSDEDRKENIRRIGEVAKLFVEQGTIVITAFISPFKEDRGLVRQLVEEDEFHEVYVKCDLATCEERDPKGLYKKARNGEIPFFTGIDSPYEEPETPELVLDTGAHNREECKNQLVQYVKDQTK

SEQ ID NO: 5880 - protein, 257 aa, Bacillus licheniformis
MGKVYIVGAGPGDPDLLTIKALKAIQTADVILYDRLVNKQILQHAKEGADLIYCGKLPDYHMMKQETINHFLVKYAKKGKTVVRLKGGDPFVFGRGGEEAQTLAEHGVAFEIVPGITSGIAAAAYAGIPVTHREASSNVAFVTGHYQKEENFEEKWKALATGIDTLVIYMGIKNVKQIERLLIENGRDPSTPAAFIHWGTTDKQKTVLCTVETLAGTVESEKIENPSLIVIGDVVQFSSQLSWFEPELKDPALSEAL

SEQ ID NO: 5881 - protein, 261 aa, Bacillus licheniformis
MKQAILYIGHGSRLKRAQTEAAAFLESCKENMSAPIQEISFLELAAPDIETGFKACVEKGATHIAAVPLLLLTAAHAKRDIPEELARASSQYPSVSVAYGKPIGVDQEVVKAVFTRIEETGTPYEHARVVLIGRGSSDPDVKRDVYDICERLRDLTPVDEVIPCFMTACEPHYLDVFKQLKERDGKTTFIVPYLLFTGMLMNEIERETAKLKETNPNVVLTDYLGFHPHVKNAFLHRVEEAVINKAGRFDFTGASDAAAAH

SEQ ID NO: 5882 - protein, 164 aa, Bacillus licheniformis
MLPLHINMKGKAAVIAGGGKIAARRLKTVLAEGASATVISPEASEEMLGLINEHGIEWKKKKAEPGDFKNAFLIILATDDHEANKRLAASAAPEQLVNVASEAELGNVYVPKIINRGNITISVSTNGASPRHTIRLAGQIDDLIDDELVQEIDELFRKRRGLNP

SEQ ID NO: 5883 - protein, 570 aa, Bacillus licheniformis
MSFDGIFTYGMIEELNEAIRGGRIAKIHQPFKHELVFHIRANGKNRKLLLSAHPSYARVHLTNETYDNPSTPPMFCMLLRKHLEGGFIDQVEQIGMDRMMVFHIRSRNEIGDTLTRKLMVEIMGRHSNIVLTDGEKDVIIDSLKHLSPAMNSYRTVLPGYDYILPPAQNKLSPLEAETEDILRHLNFQEGKLDRQIVDTFSGVSPLFAKEAVFRAGLANRATLPNVLTEMFSEIKSRRFQPQLVTTEDGKEYFYLLELTHIKGDNRPFHTLSELLDRYYFGKAERDRVKQQAHDLERFAANEKKKNENKIKKLKKTLEQSEHAQDYQLYGELLTANLYQLKKGDKEAKVINYYDENGGEITIPLNPNKTPSENAQSYFTKYQKAKNSVEVVKEQIKLAEEEIAYFDQLIQQLSSASPKDITEIREELAEGKYLRAKQQGGQKKQKKQAPTLEAYESSSGETILVGKNNKQNEYLTMKLAARDHIWLHTKDIPGSHVVIQSTDPDEQTILEAAQIAAYYSKAKNSASVPVDYTKIRHVKKPNGAKPGFVTYDSQQTVFVTPDEDLIIKLKK

SEQ ID NO: 5884 - protein, 890 aa, Bacillus licheniformis
MKWHEMGQTELLNITKTSIDKGLTEKEAGKRLERHGTNELQEGEKTSAVALFFSQFKDFMVLVLLAATLISGFLGEYIDAIAIIAIIFVNGILGFFQERRAERSLEALKELSAPQVAVLREGNWVKIPSKELVPGDVVRFASGDRIGADLRLVETKSLEIEESALTGESLPVSKQADAFQASDVSLGDLKNMAFMGTLVTRGSGIGVVIGTGMNSAMGKIADMLESAGNTATPLQRRLEELGKILIVAALFLTLLVVAAGVIQGHDLYSMFLAGVSLAVAAIPEGLPAIVTVALSLGVQRMIRQKSIVRKLPAVETLGCASIICSDKTGTMTQNKMTVTHVWSGGKIWNVSGIGYEPEGSFSMNGRDVQAKHHKPLQQVLLFGALCNSSSIIEKDGEFRLDGDPTEGALLTAARKAGFTDKYVDEHFKIIEEFPFDSTRKMMSVIVEDKSGKRFVITKGAPDVLMKRSSHTLTEEKREIFTKERLAETSAALETLASQALRTIAVAYKPIKDTENPPLEKAESGLTFIGLLGMIDPPRPEVKTAIKECREAGIKTVMITGDHVITATAIAKDLGLLPPRGKVMDGQMLNELSQEELAEIVDDVYVFARVSPEHKLKIVTAYQENGHIVAMTGDGVNDAPAIKQADIGISMGITGTDVAKEASSLILVDDNFATIKSAIKEGRNIYENIRKFIRYLLASNVGEILVMLFAMLLALPLPLVPIQILWVNLVTDGLPAMALGMDQPEDDVMQRKPRSPKEGVFARGLGWKVVSRGFLIGIATLGAFMFIYNRNPEALEYAQTVAFATLVLAQLIHVFDCRSERSIFDRNPFENIYLLGAVLSSILLMLVVIYYPPLQPIFHTVPILMADWLLIVGMSAIPTFLLAGSLLTRKK

SEQ ID NO: 5885 - protein, 287 aa, Bacillus licheniformis
MTGFGSASKTKDGLTAAVELKSVNYRFKEVNARMPRPLLYLEDKIKQTIFKHIQRGRLELFVSVDDEALVTRKIQVDWPLLEEYQKAAREMKDRCGLSGDITLQDAFQFEHVIQVEEEPIQNDKLEEVLLEAVEAAVLELCSMREAEGLRLKDDCLQHIERLEKLTDDIAELAPKVVDHYRERLEARLEEWSTDGLDESRLLTEVALFADRSDITEEVTRLKSHFRQFRDICKAGGAAGRKLDFLVQELNREANTIGSKANDHQITKHVVEMKSSIEKIKEQVQNIE

SEQ ID NO: 5886 - protein, 89 aa, Bacillus licheniformis
MTIKLINIGFGNIISANRLISIVSPESAPIKRMIQDARDRGMLIDATYGRRTRAVVIMDSDHIILSAVQPETVAQRLSVKEEIMDEGQG

SEQ ID NO: 5887 - protein, 212 aa, Bacillus licheniformis
MKGRDKSFMKERGLLIVLSGPSGVGKGTVRQALFAQEDTKFEYSISVTTRKPRQGERDGVDYFFKTREEFEEMIENNKLLEWAEYVGNYYGTPVDYVEQTLESGRDVFLEIEVQGALQVRKAFPEGLFIFLAPPSLAELKNRIVTRGTETEATIENRMKAAKEEIELMDAYDYVVENDSIELACERIKAIVLAEHLRRDRVAPRYKKMLEVE

SEQ ID NO: 5888 - protein, 66 aa, Bacillus licheniformis
MLDPSIDSLMNKLDSKYTLVTVSARRAREMQMNKDAQIENPKSHKFVGKALEEIDAGLLTFEKENR

SEQ ID NO: 5889 - protein, 405 aa, Bacillus licheniformis
MLKNRNILLGVSGGIAVYKAAALTSKLVQAGANVKVIMTKSACEFVSPLTFQALSRNEVYTNTFEEPNPRVIAHIDAADWADLVIVAPATANVIGKLASGIADDMLTTTLLATTAPVWIAPAMNVHMYDHPAVQRNISVLYKDGYRFIEPSEGYLACGYIGKGRLEEPERIVQLAESYFSSEKSGLLEGKRVVITAGPTREQVDPVRFFSNRSTGKMGYAFAEEAARMGAHVTLIAGPTSLDDPAGVDVIHVQSAEDMYQAALSVFDESDIVIKTAAVADYRPKHVHDQKMKKKDGGLVIELERTKDILKALGERKTKQILVGFAAETQHVEDYAKQKLETKNLDMIVANNITAEGAGFGTETNIVTVFHRDCKKTAHPLMSKREVAAAVLKEAAELAGRSGTSS

SEQ ID NO: 5890 - protein, 805 aa, Bacillus licheniformis
MNFAEVIVDVTTKNIDRPFDYRIPDKFKGMIKKGMRVIVPFGARKIQGFVTSVKESSELAGRSVKDIEDILDLAPVLTEELLELSDWLTEKTLSFKITALQAMLPAAMKAKYGKEIKVIGDKPLPEPLKTLFSQKETLSYSDINDHGTLKLIQRQVQEGNLEVAYKVKQKTNKKMRRMIAPLCAKEHLKEALAGLSPQAVKQKAILQFFIDRKEGGAVPAKDLIDKTGGSSASLKALIDKGLLKESEEEVYRDPYQDRMFKKTEPLPLTEEQAQAYEAIADAIEEKRHDVFLLHGVTGSGKTEVYLQSIEKVLEAGKEAIVLVPEISLTPQMVNRFKGRFGSQVAVLHSGLSTGEKYDEWRKIHRKEVRLVVGARSAIFAPFENLGMIIIDEEHETSYKQEEMPRYHAKEAAIQRAKYHRCPVVLGSATPTLESFARAKKGVYKLLSLKHRVNHQVMPDVSLVDMREELRSGNRSMFSKDLMAGLEETLEKGEQAVLFLNKRGYSSFVMCRDCGYVIQCPHCEISLTYHRYGQRLKCHYCGYETGMPSSCPECGSEHIRYFGTGTQRVEEELTKVLPAARVIRMDVDTTSRKGAHEKLLTSFGRGEADILLGTQMIAKGLDFENVTLVGVLSADTMLHIPDFRAAEKTFQLMTQVSGRAGRHEKPGKVIIQTYTPSHYSIQLTKTHDYETFFRQEMLHRREQAYPPYYYLALVSVSHEEVTKAALVTEKIATYLKKNISSEAKILGPVASPIARIKDRYRYQCVIKYKQENQLTSLLKNIMDHYKRDIEQKQLAISIDMNPYMMM

SEQ ID NO: 5891 - protein, 160 aa, Bacillus licheniformis
MAVKPIVTYPAEVLETPAEPVASFDKSLKKLLDNMYDTMLELDGVGLAAPQIGVSKRAAVVDIGDDTGRIELVNPEVIEESGEQTGPEGCLSFPDLYGEVKRSDYVKVKAFDRRGKPFTIEAEGFLARALLHEIDHLDGILFTSKVTRYYDAEELEEMEG

SEQ ID NO: 5892 - protein, 316 aa, Bacillus licheniformis
MTRIVFMGTPDFSVPVLGTLIDDGYEVVGVVTQPDRPKGRKKVMTPPPVKEEALRRGIPVLQPEKVREEAETDKILALEPDLIVTAAFGQILPKKLLDYPKYGCINVHASLLPELRGGAPIHYAILEGKEKTGVTIMYMVEKLDAGDMLAKVEVDIEETDNVGTLHDKLSKAGAALLSETVPRIIDGSVTPEKQDEQKATYAPNIKREQELIDWSKPGEVLYNQVRGLNPWPVAYTVLNGQTLKVWAAKKCQALKQAEPGEIVTVEKDGIVVATGNDTALKLTEVQPAGKKRMKAEDFVRGAGLQAGMKLGHDDEK

SEQ ID NO: 5893 - protein, 450 aa, Bacillus licheniformis
MTMKNNVREVALDALIKLDQNQAYSNLLLQSAMKANDLSDKDRGLLTELVYGTLQNKLALDYMLKPFIKKPEKVKDWVIHLLRMSLYQMEYLEKIPDRAALFEAVEIAKRRGHKGISSFVNGVLRSVQREGVPSFADIADPIERLAVETSHPEWLVREWTDAYGFEAAEQICRIHMIPPKQTIRVNRLKNDRDTLLSRLNEAGIEAEEGDLSKDAVKLLKGTIASTPFFKEGEVTIQDESSMLVARALGPERGETVLDACAAPGGKSTHIGELLEDTGKVVSLDLHQHKVKLIKEAAGRIGLSNIEARALDARKAGEVFEPEQFDRILVDAPCSGFGVIRRKPDLKYSKTPEDSARLAGIQLAILNEIAPLLKTGGTLVYSTCTMDPTENEQVMHAFLEEHDEFEADPTLAERLPEKAAPYVKDGSIQILPHYFGTDGFFICSMRKKGSQ

SEQ ID NO: 5894 - protein, 361 aa, Bacillus licheniformis
MESKQKVRKELRTERPSIYSFEIEELKSWLSENGEKPFRAAQIFEWLYEKRVTSFEKMTNLSKELRTKLNEHFVLTTLKTAVKQTSQDGTMKFLFELHDGYTIETVLMRHEYGNSVCVTTQVGCRIGCTFCASTLGGLKRNLEAGEIVAQVVKVQQALDETDERVSSIVIMGIGEPFDNFQEMLAFLKIVNHDKGLNIGARHITVSTSGIIPKIYEFADEKLQINFAISLHAPNTEIRSRLMPINRAYKLPDLMKAVDYYIKKTGRRVTFEYGLFGGVNDQVEHAEELAELLKGIKCHVNLIPVNYVPERDYVRTPKEQIFAFEKTLKSHGVNVTIRREQGHDIDAACGQLRAKERQEETR

SEQ ID NO: 5895 - protein, 254 aa, Bacillus licheniformis
MKTALKTDRGKIRQHNEDDAGIFTEKNGLVLAVVCDGMGGHLAGDVASRMAVSALRDIWEETEEVPASPAESEAWLKEQISAVNQKLFDHSRAHEECQGMGTTVVCALYTGKTLTVAHIGDSRCYLLQGGSFIQLTEDHSLVNELVRTGGISKEDAEHHPRKNVLTKALGTDPEVKVEAHTFEIEPGDQVLLCSDGLTNKVDDETLKDMLTTLSSAEEKADQLVQLANDNGGEDNITVALLELPSQIEEGEDKC

SEQ ID NO: 5896 - protein, 657 aa, Bacillus licheniformis
MLIGRRISGRYEILRAIGGGGMANVYLALDIILDREVAIKVLRFDFVHDADFIRRFRREAQSAASLDHPNIVSIYDVGEEDDIYYIVMEYVEGMTLKEYINRTGPLHPKEAVQIMEQIVSAIAHAHDNQIVHRDIKPHNILIDHMGHIKVTDFGIAMALSSTTITHTNSVLGSVHYLSPEQARGGLSTKKSDIYSLGIVLFELLTARMPFEGESAVSIALKHLQSETPSVKRWNPAVPQSIENVVLKAMAKDPFHRYEAAEEMENDLKTAFDPDRLNEKRFTIPSDDEMTKAVPIIKNLPENGSSSQSGGGEEEAAPLSKKEKKKQAKANKKKKRKKWPLILLTVFFVLAASAVLALTVFPSLFIPKDVAVPDVAGLEYEEAVIKLEDEGFEVDPNAEDIADDKIEEGLIVKTDPAAGDIVKEGSTVKLYKSSGKEKTEVDDVVGQKVDAAKKLLEQKGFKNIKTEEVHDEEEAGTIIEQDPAAGTEIVAADDEVKLTVSLGPEAITLRDLKTYSKQAASGYLDDHQLVLVEKEAHSEDVPEGQVIKQKPEAGASVKPGDKVEVTFSLGPKQKPVKTVTEKIDIPYEPGAAGEEQNVQISIDDEEHSISDVYENFKITAPAERTIKFRIAPGQKGYYQVTINDKVVRSKTIEYPEDE

SEQ ID NO: 5897 - protein, 294 aa, Bacillus licheniformis
MPEGKIIKALSGFYYVLDGDQVIQCRGRGVFRKNKVTPLVGDDVVYQADNDKEGYILEIKDRFNELVRPPISNVDQAVLVFSAKEPTFSTSLLDRFLVLVEAGDIRPIICITKMDLVDDDALKEQIHQYAEDYRNIGYSVYLTSMKSGRGIEDIIPHFQDKITVFAGQSGVGKSSLLNAISPDLELKTAGISAHLGRGKHTTRHVELIDINGGLVADTPGFSSLEFAGIEAEDLGQTFLEIGEKSAECKFRGCLHIKEPNCAVKRAVENGEIAQYRYNHYVEFLTEIKDRKPRY

SEQ ID NO: 5898 - protein, 218 aa, Bacillus licheniformis
MVYVAPSILSADFARLGEEIRDVEQGGADFIHIDVMDGHFVPNLTIGPLVVEAVRPITELPLDVHLMIEAPDRYIPAFAKAGADILSVHVEACPHLHRTIQLIKEQGVKAGVVLNPHTPVQQIEHVLEDLDLVLLMTVNPGFGGQSFISSVLPKIRQVKEMAEQKGLADLLIEVDGGVNKNTARQCIEAGANLLVAGSAVYNEKDRKKAISDIKGALG

SEQ ID NO: 5899 - protein, 214 aa, Bacillus licheniformis
MKTINIVAGGPDHLIPDLLQYQAGDALWVGVDRGAVTLLDAGIVPDEAFGDFDSITDEQKKAIEKAAPRLHIYQAEKDQTDLDLALSWAVGQRPSFIRMFGISGGRADHFLGNLHLLYTAMKQNVKTVMIDRQNTISMHPPGSYTVMHDQTKPYISFLPFAETVKNLSLEGFKYSLNKCHIALGSTLCISNELIHSQGAFSFSEGILIMIRSTD

SEQ ID NO: 5900 - protein, 26 aa, Bacillus licheniformis
MKFYTIKLPKFLGGIVRAMLGSFRKD

SEQ ID NO: 5901 - protein, 62 aa, Bacillus licheniformis
MARKCVITGRKSRSGNSRSHAMNASKRTWGANVQKVRILVNGKPKKVYVSARALKSGKVERV

SEQ ID NO: 5902 - protein, 120 aa, Bacillus licheniformis
MSIEFRTKYGQIDISNEVVAMVAGGAAIDCYGIVGMASKNQIKDGLTEILRKENFARGVIVRQEEDRIHIDMYIIVSYGTKISEVAHNVQTKVKYTLDHTVGLAVDSVNIYVQGVRVTNP

SEQ ID NO: 5903 - protein, 556 aa, Bacillus licheniformis
MSIRNLDGKAFADMILYGAHHLSQNANVVDALNVFPVPDGDTGTNMNLSMTSGAKEVEQIDTANIGKVAQSLSRGLLMGARGNSGVILSQLFRGFGKSIEQKSEINAKEFAAAFQAGVDTAYKAVMKPVEGTILTVAKDAAKKAVLAAQTETNIIKVMEAVVNEAEASLERTPELLPVLKEVGVVDSGGKGLLYVYEGFLASLKGEKLSDKAAALPSLDDLVSAEHHKNAQSHMNTEDIEFGYCTEFMVKLDSGKRNFNEVAFRQDLSRFGDSLLVVSDENIAKVHIHAEYPGEVMTYAQKYGSLINMKIENMREQHSAILSQNKQETAPAEKAPADKQPYGIVTVAMGEGIAELFESIGATKVIEGGQTMNPSTEDIVQAIKDANADTVVILPNNSNIVMAANQAADVAGQHVIVIPTKTVPQGMAALLAFNPALSADENEAAMLGAIGEVKSGQITYAVRDTNIDGIDIKKGDFMGILNGKIVETASDQLTAAKKLIAGMIDEDSEIVTVIKGEDAPEEEAEELAAYISETYEDVEVEVHDGKQPLYSYILAVE

SEQ ID NO: 5904 - protein, 220 aa, Bacillus licheniformis
MKYRSVFDIIGPVMIGPSSSHTAGAARIGRVARSVFGREPKQIIVSLYGSFAETYKGHGTDVAIIGGLLDFDTFDERIKDSIRLAEEKGIAIEFREEEAVPKHPNTARILISDDEGSLELAGISIGGGKIEIIELNGFELRLSGNHPAILVVHNDRYGTIAGVANVLAKFAINIGHMEVARKDVGQEALMTIEVDQTIDPAVFDELRALPNIIEVTQIAD

SEQ ID NO: 5905 - protein, 300 aa, Bacillus licheniformis
MFRNVKELIQLTKEKNVSISEIMITQEIEVTGRTREDIFKQMEANLAVMEDAVQKGIEGVVSHSGLTGGDAVKLQAYLKSGKGLSGDVILDAVSKAVATNEVNAAMGTICATPTAGSAGVVPGTLFAVKEKLHPTKEQMVRFLFTSGAFGFVVANNASISGAAGGCQAEVGSASGMAAAAIVEMAGGTPEQCAEAMAIALKNVLGLVCDPVAGLVEVPCVKRNAMGAANAMVAADMALAGITSRIPCDEVIDAMYKIGQTMPTALRETGRGGLAATPTGKELEKKIFGGASAARGTQSAT

SEQ ID NO: 5906 - protein, 682 aa, Bacillus licheniformis
MEHNLQLSISVIKGVGTETEKTLNELGIYTVLDLLNYFPYRYDDYELRDLEDVAHDERVTVEGKVHSEPSLAYYGKKRSRLTFRLLVGNYLITAVCFNRPYLKKKLAIGSIVTVTGKWDKHRQSVMVQELKNGPHQGDQSIEPVYSVKENITVKTMRKLIQEAVRSHLPFAEDPLPEKLRTAYKLLSYQEAVKAMHKPESREALKHARRRFVYEEFLLFQLKMQALRKFEREASDGISHTFRLEDVNSFVKSLPFPLTNAQAKALDDILRDMASGYKMNRLLQGDVGSGKTAVAAIALYASLLSGFQGAMMVPTEILAEQHADSLVSLFEQHDVNVALLTSSVKGKRRRELLERLKEGEIDILVGTHALIQDDVHFKQLGLVITDEQHRFGVEQRKKLRSKGKDPDVLFMTATPIPRTLAITVFGEMDVSVIDEMPAGRKRIETYWVKHDMLERILAFIDKELKKGRQAYVICPLIEESDKLDVQNAIDVHSMLTHAFRGRWQIGLMHGKLSNDEKEQVMRQFSKNECQILVSTTVVEVGVNVPNATVMLIYDADRFGLSQLHQLRGRVGRGDHQSYCILMADPKSETGKERMSIMSETTDGFELSEKDLELRGPGDFFGKKQSGMPEFKVADMVHDYRALETARRDAAELVSSKAFWTDAEYKSLREHLQNSGVMDGEKLS

SEQ ID NO: 5907 - protein, 188 aa, Bacillus licheniformis
MRKSKRERQELLQQTIRTTPFITDEELAEKFNVSIQTIRLDRLELSIPELRERIKSVAEKSLEDEVKSLPLDEVIGEIIDLELDEHAISILEIRREHVFSRNQIARGHHLFAQANSLAVALIDDELALTAKADIRFTRQVKQGERVVAKAKVVKLDKDKGRTVVEVNSYVAEEPVFSGEFVMYRSKQS

SEQ ID NO: 5908 - protein, 330 aa, Bacillus licheniformis
MKIAVDAMGGDNAPKAVIEGVMKAVEDFEDLEITLIGDREKIAAHLTEHGRITVKHAEEVIEATDEPVRAVRRKKNSSMVLMAGEVAEGRADACISAGNTGALMTAGLFIVGRIEGIERPALAPTLPTVSGDGFLLLDVGANVDAKPEHLVQYAIMGSVYGEQVLGVKNPRIGLLNVGTEDKKGNELAKQTFQKLKETDLNFIGNVEARDMLDGVADVIVTDGFTGNVALKTVEGAALSIFKMLRTTLTSSFTAKLAASALKPKLKEMKTKMDYSEYGGAGLFGLKAPVIKAHGSSDGRAVYHAIRQAREMVSQNVAAFIEEKIQQKADE

SEQ ID NO: 5909 - protein, 319 aa, Bacillus licheniformis
MGKIAFLFPGQGSQHIGMGHELYEKEPNAKKIFEEADQTLETKLSTLMFEGDAKELTLTYNAQPSLLTASIAALEKLKEYGIKADYAAGHSLGEYSALVAAGALSFKDAVYAVRKRGEFMNEAVPAGEGAMAAILGMDSQALKEVTDKISEEGNLVQLANLNCPGQIVISGTAKGVELASELAKEKGAKRAIPLEVSGPFHSELMKPAADKLREVLDACTINDAAIPVVSNVTADFVTDKDDIKNKLIEQLYSPVRFEETISRLIDEGVTTFIEIGPGKVLSGLVKKVNRRVKTIAVSDPNTIELAVQTLKEENENAGK

SEQ ID NO: 5910 - protein, 247 aa, Bacillus licheniformis
MLENKTAVVTGASRGIGRAIALDLAKNGANVVVNYAGNEAKANEVVDEIKALGRDAFAFKADVSNADEVQAMMKEAVGRFGTLDILVNNAGITKDNLFMRMKEDEWDDVININLKGVFNCSKAVTRQMMKQRSGRIINITSVVGVVGNAGQANYVAAKSGVIGLTKTLAKELASRNITVNAIAPGFISTEMTDKLTKDIQDEMLKQIPLARFGEPSDISSAVVFLASDHASYMTGQTLNINGGMAMV

SEQ ID NO: 5911 - protein, 77 aa, Bacillus licheniformis
MADALERVTKIIVDRLGVDEADVTLEASFKEDLGADSLDVVELVMELEDEFDMEISDEDAEKIATVGDAVNYINSKQ

SEQ ID NO: 5912 - protein, 181 aa, Bacillus licheniformis
MELTISQFLYAKYPAMSEGDLTKLRAAIVCEPSLVSLAHELSFGELVLLGKGEEMTGGRKRPALLADVFEAFIGALYLDQGLEAVVTFLKAYVFPKIDDGAFSHVMDFKSQLQEFVQRDGRGILEYKILQEKGPAHNREFEANVSLKGEVLGVGSGRSKKEAEQHAAQEALAKLQKHHMKQ

SEQ ID NO: 5913 - protein, 1186 aa, Bacillus licheniformis
MFLKRLDVIGFKSFAERISVDFVKGVTAVVGPNGSGKSNITDAIRWVLGEQSAKSLRGGKMEDIIFAGSDSRKKLNLAEVTLTLDNDDRFLPIDFHEVSVTRRVYRSGESEFLINNQPCRLKDIIDLFMDSGLGKEAFSIISQGKVEEILSSKAEERRSIFEEAAGVLKYKTRKKKAENKLFETQDNLNRVEDILHELEGQVEPLKVQASIAKDYLEKKDELEKIEIALTAYDIEELHGKWEALQQKVEKAKDEEMSSSAAIQAKEAKIEEARDKIQALDESVDELQQVLLLTSEELEKLEGRKEVLKERKKNATQNRAQLEEAIVQRSEKERTLKEKIAAQKLVFEKLETEAKELARQVKEKNQALSGYSENVEEEIEQLKSDYFELLNEQASVRNELQFLEDQMTQSAAQQKRLAQNNEKYLSERKEIADQKMKTEHEFSLVDERLHSQIQAFRDAQKSYEQKKSQYEKKESALYQAYQYVQQARSKKEMLEAMQEDFSGFYQGVKEVLKAKSELPGIRGAIAELLKTDERYETAIEIALGATAQHVVTEDEDAARRAIQYLKKHSFGRATFLPLSVIKERRIQPRDIETAKENPSFIGIASELVSFDPAYRSVVQNLLGTVLITEHLKGANDLAKRLGHRYRIVTLEGDVVNPGGSMTGGAVKKKSSSLLGRNRELEAQTKRLAEMEEKTELLEKEVKALKQTIQELDAKLQSLREDGERLRSEQQEIKGRLYELEIAEKNVNSHLELYDQEKSALLEGDEDKKWRKEELEEKLASIAGELQRLDSEIEAMTERKQTQTSTKEALQSELTDLKVVLAKTEQSCANEREKLARLEEEYAENAEALKVAEEDLSFLTTEMSSNSSGEEKLEEAAKKKLNDKNKTAELIASRREQRMKLQKGLETEELELKEMKRQYKQMAGLLKDEEVKLGRMEVELDNLLSFLREEYGLSFEGAREKYPLELSPEEARKRVKLIKLAIEELGTVNLGSIEEFERVNERYLFLSEQKDDLLEAKNTLFKVIEEMDEEMTKRFAETFAQISSHFEDVFRALFGGGRAELKLTDPNDLLQSGVDIIAQPPGKKLQNLSLLSGGERALTAIALLFSILKVRPVPFCVLDEVEAALDEANVFRFAQYLKKYSHETQFIVITHRKGTMEEADVLYGVTMQESGVSKLVSVKLEETKELVQ

SEQ ID NO: 5914 - protein, 328 aa, Bacillus licheniformis
MSFFKKLKEKITQQTDSVSGKFKEGLAKTRNTFQERVNELVSRYRKVDEDFFEELEEVLIGADVGVATVMELIDELKSEVKRRNIQDPKEVQSVISEKLVEIYEGGEQEASELRVEDGRLNIILFVGVNGVGKTTTIGKLAHQFIKEGKNVVLAAGDTFRAGAIDQLEVWGERVGAHVVKQAERSDPAAVIYDAVQAAKARGADVLLCDTAGRLQNKVNLMKELEKVKRVIQREVPDAPHEVLLVLDATTGQNAMTQAREFSKATDVSGIVLTKLDGTAKGGIVLAIRHELQIPVKFVGLGEKMDDLQPFEAESYVYGLFSDLIEKEE

SEQ ID NO: 5915 - protein, 85 aa, Bacillus licheniformis
MTLEKTTRMNYLFDFYQTLLTSKQKSYMSLYYLDDFSLGEIAEEYHVSRQAVYDNIKRTEAMLEQYEEKLLLFKKFQERKKILKR

SEQ ID NO: 5916 - protein, 446 aa, Bacillus licheniformis
MAFEGLADRLQQTISKIRGKGKVTEQDVKEMMREVRLALLEADVNFKVVKDFVKKVSERAVGQDVMKSLTPGQQVIKVVKEELTELMGGEESKIAAAKRPPTVIMMVGLQGAGKTTSTGKLANLLRKKHNRNPLLVAADIYRPAAIKQLETLGKQLDMPVFSLGDKVSPVEIAKQAIEKAKEDHHDYVLIDTAGRLHIDEELMDELEQVKETAQPEEIFLVVDSMTGQDAVNVAKSFNEQLGVTGVILTKLDGDTRGGAALSIRAVTNTPIKFAGMGEKLDALEPFHPERMASRILGMGDVLTLIEKAQANVDEEKAKELEQKMKNMSFTLDDFLEQLGQVRNMGPLEDLIQMMPGAGKMKGLKNVKVDEKQLSHIEAIIKSMTGKEKEQPEIINASRRKRIAKGSGTSVQEVNRLLKQFEEMKKMMKQMTNMTKGKKKGFKLPFM

SEQ ID NO: 5917 - protein, 90 aa, Bacillus licheniformis
MAVKIRLKRMGAKKSPFYRIVVADSRSPRDGRFIETVGTYNPLAKPAEVKIDEELALKWLQTGAKPSDTVRNLFSKEGIMEKFHNAKQSK

SEQ ID NO: 5918 - protein, 81 aa, Bacillus licheniformis
MSDLHLEELIVSLVKPLVDHPDDVQVFKEENPERIMFRLSVNREDTGKIIGKKGRTARAIRSVVFAAGAQSSKKVQLEIAD

SEQ ID NO: 5919 - protein, 128 aa, Bacillus licheniformis
MQIIQRVTVMQVLTENSKKKLLASFEERKEILERECNQLYFQLRKHEKEHHNPAATESFKKEIEKRQDKIKMIVFQINQIHTLPLGSEVKEKEIDALMDIEVGDNWHDMTAGKTIVIKDGIVIEIRPR

SEQ ID NO: 5920 - protein, 174 aa, Bacillus licheniformis
MLKQWFNVGKIVNTHGVKGEVRVISRTDFPEERYKPGNALYLFLEGKDEPVQVTVSAHRLHKQFHLLQFKEVETLTEAEKLKNALIKVPEDQLSQLAEDEYYFHEIIGCDVFSEDGDLIGKVKEILTPGADDVWVVARPGKKDALIPYIDAVVKEINVADKTIKIHIMEGLLDE

SEQ ID NO: 5921 - protein, 231 aa, Bacillus licheniformis
MKGVLGSSILQKAQDKDAVRFRVVNFRAYSDNKHQTVDDYPYGGGAGMVLKPQPVFDAVEKLTAEAGGSPRIILVCPQGERYTQQKAEELAREEHLMFICGHYEGYDERIREHLSTDEISIGDFVLTGGELPAMMIADSVVRLLPGVLGKEESHLEDSFSTGLLEHPHYTRPADYKGLKVPDVLTSGNHAKIKEWRRKESLRRTFLRRPDLLENYPLSEEERKWISEWKNR

SEQ ID NO: 5922 - protein, 115 aa, Bacillus licheniformis
MQKLIEEITKEQLRTDLPAFRPGDTLRVHVKVVEGNRERIQVFEGVVIKRRGGGISETFTVRKISYGVGVERTFPLHTPKIAKIEVVRHGKVRRAKLYYLRELRGKAARIKEIRR

SEQ ID NO: 5923 - protein, 283 aa, Bacillus licheniformis
MVIQWFPGHMAKARREVTEKLKLIDIVYELVDARIPMSSRNPMIEDILKNKPRIMLLNKADKADSSVTKAWKQHFEKDGIPTLAINSVNGQGLNQILPASKELLKEKFDKMKAKGVKPRAIRALIVGIPNVGKSTLINRLAKKNIAKTGDRPGVTTAQQWVKVGKELELLDTPGILWPKFEDELVGLRLAATGAIKDSIINLQDVAVYGLRFLEENYPERLKKRYDLEEIPEEIAALFDEIGKKRGCLMAGGEINYDKTTEVIIRDIRTEKFGPLSFEKPEDM

SEQ ID NO: 5924 - protein, 255 aa, Bacillus licheniformis
MKTLTVKEIKEHLQSVSDEKDPFIEQCKNDERKSVQALVDAWLKKNERLSAMREEWQAMTSFERSLRARGYQYIAGIDEAGRGPLAGPVVAAAVILKEDCEILGLTDSKKLSKQKREDYYSYIMEEAAAVGVGIADAHEIDELNIYEASKAAMLKAVQALDVAPDYLLIDAMSLAVDTEQSSIIKGDAKSASIAAGACIAKVTRDRLMDEYAEKYPLYGFEKHKGYGTKEHLNALAKYGPSPIHRRSFAPVKAHE

SEQ ID NO: 5925 - protein, 563 aa, Bacillus licheniformis
MMMLNDVHNSLRKQFEQADSLQRISGTETDQKRLMLGKVLRFISEQFAEIQIGNTKWQGKLEAPLKAGAHYWFSYEKKPDEATGRLQVVEAFDKNPKTVQDAAFKLLNGLSLKRTKEAVFLVGALLKEQQPIRENDLRAAIKWLENLPKSDAQKGADAVMFALKRELPVHPGVLDSIMAVKSPVPLNEQIARTLDMIANAAQPSPGMEKLKQALLPVLQAETEVHAERLIQKLAEHIRSLEKGELQAVLPLKPQVQSEGGKPPQKADAGGAYGQEAKAAQHNPQIAAAKDVFAKLAAQAETNGTHIAREAAGVIKALESRGALGQAPAVLEGFTPKETELLQHIMKETAPALTNKADVLSVLLKIKDVLGVRDELSLLRAMENGAVLKEQGLQSLKLVLNEMRHASDLPAPVKQEADQIFHRLNGQLFLQNDQPAQSQLFLSYPLFSKNGVQDLNVFLKGQKKDDGKIDPSQCRLMFYLQLEALEETVIDCLIQQNVMTVTIETKFDLESLIEPLVPALKENLKELGYSLSGVSAKKRENMKLAPFLESRFEQITESAVDVKI

SEQ ID NO: 5926 - protein, 93 aa, Bacillus licheniformis
MKESVPLRRAVALHYDEMKDKAPKVVAKGSGYTAEKIIEEAQKAGVPIQEDATLVELMRHLELDDHIPEALYEIVAEIFSFVYTLDEKMKKRE

SEQ ID NO: 5927 - protein, 386 aa, Bacillus licheniformis
MNIHEYQGKEVLRKYGVAVPEGKVAFTADEAVKAAEALSSSVYVVKAQIHAGGRGKAGGVKIAKSKEEVKAYAEELLGKTLVTHQTGPDGQQIKRLLIEEGCDIKKEYYVGLVLDRATSRIVLMASEEGGTEIEEVAEKTPEKIVKEVIDPAVGLQSYQARKIAFAINIPKELVGQAVKFMMGLYKAFTEKDCSIAEINPLVVTGDGKVMALDAKLNFDSNALYRQKDILEYRDLDEEDPKEIEASKYDLSYISLDGNIGCMVNGAGLAMSTMDIIKHYGGEPANFLDVGGGATAEKVTEAFKIILSDQNVKGIFVNIFGGIMKCDVIAEGVVEATKQVGLTLPLVVRLEGTNVDLGKKILDDSGLNITSAESMADGAQKIVSLVK

SEQ ID NO: 5928 - protein, 300 aa, Bacillus licheniformis
MSVFINKDTKVIVQGITGSTALFHTKQMLEYGTKIVGGVTPGKGGTEVEGVPVFNTVEEAVKQTGANASVIYVPAAFAADAIMEATDAELDLVICITEHIPVLDMVKVKRYMEGKKTRLIGPNCPGVITPEECKIGIMPGYIHKKGHVGVVSRSGTLTYEAVHQLSEAGVGQSTAVGIGGDPVNGTNFIDVLKAFNEDPDTHAVIMIGEIGGTAEEEAAEWVKANMTKPVVGFIGGKTAPPGKRMGHAGAIISGGKGTADEKIKTMNACGIEVAETPSVMGETLIKVLKEKGLYETCKTH

SEQ ID NO: 5929 - protein, 300 aa, Bacillus licheniformis
MNDSSELLILLRLRGTLSPSLLTKWWKQDPSLSLTGEKNHLLTKLSLKRSDLCSIRKLAEQELSNVKRLIRSYEAAGVRMTAISSPDYPASLKTIHDPPPVLFLKGNKKLLHEQRKIGIVGTRCPSLYGKRAAVQLVRELCKNSWTIVSGLAKGIDGLAHQESIRSKGRTIGVIAGGFNSIYPREHRQLAGQMAESHLLVSEHPPHIKPQKWHFPMRNRLISGLTEGIVVVQGKEKSGSLITAYQALEQGREVFAVPGPIFDANSFGPSRLIQEGAKLVLTIEDILNELPPSNAQYTEPV

SEQ ID NO: 5930 - protein, 691 aa, Bacillus licheniformis
MSEYLVIVESPAKAKTIERYLGKKYKVKASMGHVRDLPKSQMGVDIEQNFEPKYITIRGKGPVLKELKTAAKKAKKVYLAADPDREGEAIAWHLAHSLDLDLNSDCRVVFNEITKDAIKESFKHPRMINMDLVDAQQARRILDRLVGYKISPILWKKVKKGLSAGRVQSVALRLIIDREKEINDFIPEEYWTIEGSFLKGKETFEASFFGINGEKHQLKSEDDVKQILSRIKGNKFEVKKVTKKERKRNPALPFTTSTLQQEAARKLNFRAKKTMMIAQQLYEGIDLGKEGTVGLITYMRTDSTRISNTAQEEAASFIGEQYGKEFLGSKRKPAKKNENAQDAHEAIRPTSVLIKPSDLRAVLGRDQLRLYKLIWERFVASQMAPATLDTMSVDLENNRLTFRANGSKVKFSSFMKVYVEGKDDQMEEKNKMLPDLAEGDTVLSKDIEPEQHFTQPPPRYTEARLVKTLEELGIGRPSTYAPTLDTIQKRGYVALDNKRFIPTELGEIVLDLIMEFFPEIINVEFTAKMEKELDDVEDGNIQWVQIIDSFYKDFEKRVEKAEAEMQEVEIEPEYAGVDCEACGHPMVYKMGRYGKFMACSNFPDCRNTKPIVKEIGVKCPSCKTGNIVERKSKKRRIFYGCDRYPECEFVSWDKPLERKCPKCEDMLVEKKLKKGVQVQCVNCDYKEEQQK

SEQ ID NO: 5931 - protein, 434 aa, Bacillus licheniformis
MNQTVNVIGAGLAGSEAAWQLAKRGINVRLYEMRPVKQTPAHHTDKFAELVCSNSLRANSLTNAVGVLKEEMRVLDSAIIAAADECSVPAGGALAVDRHEFAANVTEKVKNHPNVTVLHEEVTEIPEGPTIIATGPLTSEALSAKLRELTGEDYLYFYDAAAPIVEKDSLDMDKVYLKSRYDKGEAAYLNCPMTEEEFDRFYDALVSAETVPLKEFEKEIFFEGCMPIEVMAKRGKKTMLFGPMKPVGLEDPKTGKRPYAVVQLRQDDAAGTLYNIVGFQTHLKWGDQKEVLRLIPGLEQAEIVRYGVMHRNTFINSPSLLKATYQFKKRDDLFFAGQMTGVEGYVESAASGLVAGINAARLIQGKEPVTFSNETAIGSMAHYITETNKKNFQPMNANFGLFKELGVKIKNKQERNEQYASRALETIRNISKTL

SEQ ID NO: 5932 - protein, 304 aa, Bacillus licheniformis
MANVKNFLTLFIEYLQIEKNYSKYTIVGYISSIEDFERFLHVQGIKGFEDVTYPDVRIFLTEAHEKGLTRRTISKKISALRSFYKFLLREKLVKENPFLLVSLPKQDKRIPKFLYEKELEELFEVSDLSTPLGQRNQALLEFLYATGMRVSELCSLKESDLDLFLDTVLVHGKGRKQRYIPFGSFAREALDLYLQNGRRILLLKAKEPCPFIFLNQRGGPLTPRGVRYILGELVKKTSGTLHIHPHMLRHTFATHLLNEGADLRSVQELLGHSNLSSTQVYTHVSKDMLRKTYMSHHPRAHKGK

SEQ ID NO: 5933 - protein, 181 aa, Bacillus licheniformis
MSSFHATTIFAVQHNGKSAMAGDGQVTFGQAVVMKHTARKVRKLFNGKVIAGFAGSVADAFTLFEMFEAKLEEYNGNLQRAAVELAKEWRSDKVLRKLEAMLIVMNADSMLLVSGTGEVIEPDDGILAIGSGGNYALAAGRALKRHAGSQLDAKAIARASLETAGEICVYTNDQIIVEELE

SEQ ID NO: 5934 - protein, 467 aa, Bacillus licheniformis
MEKKPLTPRQIVERLDQYIVGQLDAKKAVAVALRNRYRRSLLDEKLREEIVPKNILMMGPTGVGKTEIARRIAKLVGAPFVKIEATKFTEVGYVGRDVESMVRDLVETSVRLVKEEKMNEVKGIAEENANKRLVRLLVPGRKKQTGAKNPFEMLFGGNQDQETGEAEKQEDADIENNRKRIAHQLALGELEDHYVTVEVEEQQPSMFDMLQGSGMEQMGMNMQDALSSLMPKKKKRRKLTVREARKVLTNEEAAKLIDMDEAAQEAVQRAEQSGIIFIDEIDKIAKKSGASSSADVSREGVQRDILPIVEGSTVMTKYGAVKTDHVLFIAAGAFHMAKPSDLIPELQGRFPIRVELQKLSIDDFVKILTEPDNALLKQYKALLKTEGISLEFSDDAIRKIAEVAYHVNQDTDNIGARRLHTILERLLEELSFEAPDVTMEEVVITPQYVEEKLGSIAKNKDLSQFIL

SEQ ID NO: 5935 - protein, 259 aa, Bacillus licheniformis
MALLQKTRKINAMLQNAAGKPVNFKEMAETLRDVIDSNIFVVSRRGKLLGFSINQQIENDRMKKMLEERQFPEDYTKSLFNIPETSSNLDINSEYTAFPVENRDLFQAGLTTVVPIIGGGERLGTLILSRLQEKFEDDDLILAEYGATVVGMEILREKAEEIEEEARSKAVVQMAISSLSYSELEAIEHIFEELDGNEGLLVASKIADRVGITRSVIVNALRKLESAGVIESRSLGMKGTYIKVLNNKFLMELEKLKSH

SEQ ID NO: 5936 - protein, 129 aa, Bacillus licheniformis
MDIFSGTIHRLEGALNQANIKQKVITNNLANVDTPNYKAKKVSFKNVLNEESSRINAIKTDYRHIDFKGNEPNYSVVSRKNTTYQENGNNVDVDQEMSEMAKNQIQYQALVERISGKFNSLRTAITGGK

SEQ ID NO: 5937 - protein, 150 aa, Bacillus licheniformis
MGVFNSINISASALTAQRVRMDTVSSNLANMDTTRAKLVDGQWQPYRRKLVSTAPKGESFSSVLQSSMNASARVGEGVKVTKISEDKTPFKLVYDPTHPDANEDGYVQMPNVDPLKEMVDLMSSTRSYEANVTAMNATKGMLMKALEIGK

SEQ ID NO: 5938 - protein, 105 aa, Bacillus licheniformis
MVNGISPFGVQSVQAGTNATNQIKNKQDGSENQVSFSNVLKDSINALNQSQNESDKLTNALALGQDVNLDEVMIAAQKANITLTAATEFRNKAVEAYQEIMRMQM

SEQ ID NO: 5939 - protein, 533 aa, Bacillus licheniformis
MNRNLLQIKTKITDFWKNRSKLQKILLIGIVALAVILSIIIGIVASSNKMVPLYKDLSAEETGQIKQVLDEKGIPSEVATDGSVIKVPEEKVDELKVDLAAEGLPKSGSIDYSFFGENAGFGMTDNEFDVLKVKATQTELSNLIKGIDGIKDSKVMINLPKESVFVGEEKPEASASIVLQVKPGHTLDQNEINGLYHLVSKSVPNLDPKNIVIMDQNSTYYDQTGKESGSYADSYSSQREVKAQIEKDLQRQIQTMLGTMMGQDKVVVSVTSDIDFTKENRTEDLVEPVDKENMEGITVSAERVSETYSGQGAQAGGVNGTGENDVTNYAETEGGTGNGDYEKSEERINNEVNRIHKEIAESPYKIRDLGVQVMVEPPDANNPQSLPAEREDDIKKILSTIVKTSIDKNYEEEPLTDEDVENKIVVSVQSFDGKQTIDEGTETGGIPMWAYIAGGAALVAVIGLIIWLVRRRKNRDDEYEEEWYETPQEPIRVADVNNEKETEETVRRKQLEKMAKDKPEEFAKLLRSWLTED

SEQ ID NO: 5940 - protein, 338 aa, Bacillus licheniformis
MAKMKQDRLTGKQKAAILMISLGLDVSASVYKHLTDEEIERLTLEISNVRAVSPEKKDEIIQEFHETAIAQEYISQGGIHYAKQVLDKALGEDKAASIINRLTSSLQVRPFDFARKADPEQILNFIQHEHPQTIALILSYLDPVQSGQILSELNQDVQAEVARRIAVMDRTSPEIINEVEQILEQKLSSTFTQDYTQTGGIEAVVEVLNGVDRGTEKTILDALEIQDPELADEIKKRMFVFEDIVTLDNRAIQRVIRDVENDDLLLSLKVASEEVKDIVFSNMSQRMAETFKEEMEFMGPVRLRDVEEAQSRIVSVIRRLEEAGEIVIARGGGDDIIV

SEQ ID NO: 5941 - protein, 255 aa, Bacillus licheniformis
MISLSNIIKQRLSSIPKKERRTISLKEVKLPETETELDTGQDPEYLLDHARQEAGKIYEKASAELEQVRRQIEEERSSWETEREALIDQAKQEGFQAGFEEGKAEARSAYQAYLDEANAIVRAARRDYEEKIEQSSEEIVELAVSLAKKVWNQKADDKEAFTALVKQVLSEMKEFDDIAIYVDPEYYTEVQSHKNELEQLLQYGAHIAIYADEKAPKGTCYVETAFGRIDAGIDTQLQQLKQKLLSLLETAGVVR

SEQ ID NO: 5942 - protein, 437 aa, Bacillus licheniformis
MLKQLLECIETADSYKRYGKVKQAVGLMIESKGPECSIGDVCKIYTKGDGPKAIKAEVVGFKDQNILLMPYLEAANIAPGSIVEATGESLRVKVGSGLIGQVVDAFGNPLDGSVLPKGLAQVSTDQAPPNPMKRPPIREKMAVGVRSIDSLLTVGKGQRVGIFAGSGVGKSTLMGMIARETAADLNVIALVGERGREVREFIEKDLGEEGLKRTIVVVATSDQPALMRLKAAYTATAIAEYFRDKGQNVMFMMDSVTRVAMAQREIGLATGEPPTTKGYTPSVFAILPKLLERTGTTESGSITAFYTVLVDGDDMNEPIADTVRGILDGHIVLDRALANKGQFPAVNILKSISRVMSNIAEKDHIRAANRFREMLSTYQNSEDLINIGAYKKGSSREIDEAIQFHPKLISFLKQEVDEAASLEESISLLKSLTGRED

SEQ ID NO: 5943 - protein, 147 aa, Bacillus licheniformis
MAYSFKFQKLLELKENEKDQSFAEYQHSVSEFEKVAEKLYESMSQKETLEKNKEIKMQTGMSVQEMRHYQQFVTNLETTIYHYQKLVMMKRNEMNEKQHDLTEKNIELKKFEKMKEKQFEMYSLQNKANELKEMDDISIAQYITQGS

SEQ ID NO: 5944 - protein, 203 aa, Bacillus licheniformis
MTEEKKAGKFQTFLFVIVIPLIFLIVVAFVGMWLLGVNFQDAASKIPVVKELVKNGEDQDIDHATKQQENKAEKLQKTIDEQKSEIETLTSDLKTSDQEIKRLKQKISSLEKTEKDEKEQDKKNAEGQGDGKVVKIYESMQSNKAAKILSELKEEEAINILDSLSKKKVTEILSKMSPDKAAVFTEKLVKNEAKNEAKKEGGE

SEQ ID NO: 5945 - protein, 459 aa, Bacillus licheniformis
MRLFDAISFDAKPAVDTAPAKTSRTPLGALFQNVLQKENSSLSPFQKGEEPSQDTPLEGLLHELKQWLSNKEDSSFNEDWLNSLQQLEELNASPDELALAEQLLQQIKELLEKAALPEQSGKTADAKALPADESGTEEPKKPDLQILGQIQQLLAAIVNENQPSLKTSQIAELLKQAPEFLAALQTKAGAEGLIDELKRQFFTKDPSQSQLLSMSNTELKSLKSLMEQMMNANAEPDQKEWKMAESELKAMLMSKKTDVSLSEKPLSFVLNRREIQTEGKQGQKEQPIQSSVLANHRTGTALIQGLQPSAAEEASAQPKSFSEQILSSWKQMKYTPFGRSTGSFTIRLNPENLGFITIKLVKQHGMFSSKIIASTQSAKELLEHNLAHLKQALPNMSVQIDRFGVPLQNSDQTFGQLADDEKNQHQPKQDQQSKQENEDFQEFLDELIETRSQDSEEEI

SEQ ID NO: 5946 - protein, 155 aa, Bacillus licheniformis
MSDTSIDTRTALGTTNTKSTTSDFLSEAKKAEKAGSGSNLGKDEFLKLLMKQLQYQDPLNPMEDREFIAQMATFSSLEQLTNLNTTMSTFVGLQDPMTMYVSWIGKEVTYEGEDSEEKTALVKSVKSSDGQYLLVLDDGTEVNPWNVTAVSHSDK

SEQ ID NO: 5947 - protein, 262 aa, Bacillus licheniformis
MLRSLYSGISGMKNFQTKLDVVANNISNINTAGYKKSRVTFKDIVSQQLSGASSTANRGSVNGQQVGLGATIGSIDIIHTNAAPSTTGRQLDMTITGDGYFRVGSGDEVYYTRSGNFYRSDEGDLVTVDGLFVLTANNGRINIPQDAQSFSIAPDGTVSYVDQNNENQTAGQISLATFSNTSGLSKAGDNLYRETLSSGDPQVVVPGEGGSGKIQTSALEMSNVDLSEEFSEMIIAQRGFQSNAKIITTSDEILQELVNLKR

SEQ ID NO: 5948 - protein, 71 aa, Bacillus licheniformis
MIKVTRLNGQPFILNALFIEQIECFPDTTITLSNGKKFVVKEDEDTVVDTIVSFYQKIQILSCDQRIEESE

SEQ ID NO: 5949 - protein, 143 aa, Bacillus licheniformis
MNKKLLGIMMTIILAIAVLGTAAFFVIKGSASEKDQNAEPSIDEVVESSVEVAEITTNLKSDNVVRLSIKLETDSKEAKEELEKRDFQIKDSVISLLANTNADELEGQKGKEKFKEQLKEKLNTNYMKEGKVKTVYITSFNLQ

SEQ ID NO: 5950 - protein, 332 aa, Bacillus licheniformis
MAGEVLSQNEIDALLSAISTGEMDADELKKEESVKKVKVYDFKRALRFSKDQIRSLTRIHDNFARLLTTYFSAQLRTYIQISVSSVDQVPYEEFIRSIPNMTILNLFEVRPLEGRIMMEINPTIAYTMMDRVMGGIGSSHNKIDSMTEIETKIMSNLFESCLTNYKDAWESITEIEPEMSDFEVNPQFVQMVSPNETVVVISLNTQIGDISGVINLCIPHVVLEPIIPKLSVHYWMQSDRIEPKPEETKSIEKRILTAQIPIVAELGSSELTIEEFLNLEIGDCITLDKSVAEPLTVLVGDKPKFLAQAGRMNRKTAIQILDHDIRGEEYGE

SEQ ID NO: 5951 - protein, 377 aa, Bacillus licheniformis
MENNNRLSQDEIDALLKGGDDTAQEQPESGLSLMEQDTIGEIGNISFGSSATALSTLLNQKVEITTPTVSVIEKSHLNDEFPHPYVSIGVSYTEGFSGNNLLVIKQEDAAIIADLMMGGDGTNADPSLGEIHLSAVQEAMNQMMGSAATSMSTVFSKKIDISPPEVDLLDVKEGEGTEQIPKEDPLVKVSFRLKVGDLIDSHIMQLYPLTFAKDLIDELTNQDGGEEPVKTEEVQTPVQEKPAPNPNSAPAQTQRQEPAPKRQGTAKVSEPVQVAPAEFQSFAPQTEAQPHLQNLDMLMDIPLSVTVELGRTNRSVKEVLELSTGSIIELDKLAGEPVDILVNQRVVAKGEVVVIDENFGVRVTDILSQAERISKLR

SEQ ID NO: 5952 - protein, 120 aa, Bacillus licheniformis
MAYKILVVDDAAFMRMMIKDILVKNGFEVVAEAQDGAQAVEKYKEHSPDLVTMDITMPEKDGITALKEIKEIDPQAKIIMCSAMGQQSMVIDAIQAGAKDFIVKPFQADRVMEAINKTLS

SEQ ID NO: 5953 - protein, 224 aa, Bacillus licheniformis
MFKKPLIFIAGLCLCAFLALPYAPALAEESGDQTVDHLFEQKGAGKEKEKAKDKDKTEEKSSLKEEAETEPPSPSVSIFDFVKMIGALLFVIFLIYALVKFMNKRNRLLKPFQYVENIGGTSLGQNKSVQLIKVGNRVLVVGVGENIQLLKEIDDEKEYKEILTQHEAAMNSKIEWQKWMDQVKVPGVQKQSGTASFSESLKAQLAELKQNRAEGRKKGQNQHE

SEQ ID NO: 5954 - protein, 221 aa, Bacillus licheniformis
MNEFMDLFNSSDAANVSASVRLLLLLTVFSIAPGILILMTCFTRVVIVLSFVRTSLATQSMPPNQVLIGLALFLTFFIMGPTFSEINKEALTPLMNNKITLDEAYTKAEAPIKTFMSKHTRQKDLALFMNYAKMETPESINDIPLSTMVPAFVISELKTAFQMGFMIFIPFLIIDMVVASVLMSMGMMMLPPVMISLPFKILLFVLVDGWYLIVKSLLQSF

SEQ ID NO: 5955 - protein, 89 aa, Bacillus licheniformis
MNSEFVISMAERAVYVTLLISGPLLALALLVGLIVSVFQATTQIQEQTLAFIPKIVAVLVGLVVFGPWMLSTILSFATELFSNLNRFAG

SEQ ID NO: 5956 - protein, 258 aa, Bacillus licheniformis
MSIIESFPAFLLVFVRITAFYVTVPLFSYRTIPAVHKIGFAFFLALVSFQAIEKPPHLDVDGIYMMLAMKEALIGLLLGLIAYMMISAVQIAGSFIDFQMGFAVANVIDPQTGAQSPLVGQFLYTMALLLMLSLNAHHLLLDGIYYSYQYIPVDKMALSFGSEEFAEFIAKSFNTMFITAFQLSAPVVACLFLVDLALGIVARTVPQLNVFVVGLPLKIAITFIMLIICMAVMFSMMQHVFEFAIRTMRDLLTLLGVA

SEQ ID NO: 5957 - protein, 359 aa, Bacillus licheniformis
MKLTLDLQFFAGEKTEKATPKKRRESRKKGQVAKSADVNTAVTLLIVFLSFLFIGPFMRDRLLGLIEKYYKELITMKVSVANIPGLFQSVVLESGLIMAPLLLTAVVSGVLSNYMQVGFLFAPEAIKPDLKKLDPLNGFKRIYSIRAIVELLKSILKIVIVGGVTFAVLWLNFDKILRIPALSAGEALSYVGWLTFLMGVSAAVALIFLAVLDYLYQKFDYEKNIRMSKQDIKDEYKKTEGDPLIKSKIKQKQKEMAMRRMMQEVPKADVIITNPTHYAVALKYDENKMDAPFIIAKGVDLMALKIRQIAKEHDVMTVENRPLARALYDQVEIDQAVPEEFFKAVAEILAYVYKTKQKI

SEQ ID NO: 5958 - protein, 678 aa, Bacillus licheniformis
MSARDLSILSGVVLIVAMLIIPFPTWMLSILIIVNISLALIVLLTTMNMQEPLQFSIFPSLLLLLTLFRLGLNVSTTRSILSNGDAGKVVETFGSFVVGGNVLVGLVVFIILIIIQFIVITKGAERVSEVAARFTLDAMPGKQMSIDADLNAGMVTEQEAKVRREKVAREADFYGAMDGASKFVKGDAIAGIIIVLINVIFGIVIGMLQKQMSIQEAASHFTLLSVGDGIVSQLPALLISTATGIVVTRAASDGNLGHDITGQLFAYPKLLYVTAGTIFLLGIFTPIGILLTGPLALLLAAGGYMLSKAGEEKEKVEDILEEEAEVDELKSPESVVHLLDIDPIEFEFGYGLIPLADANQGGDLLDRIVMIRRQLALELGLVIPVVRIRDNIALQPNEYRLKIKGNEVAKGELLLDHFLAMSPTGEDDQIEGIDTIEPSFGLPAKWIPESQKDQAEMLGYTVVDPASVVSTHITEQVKKHAHELIGRQETKQLIDHLKESYPVLVEEVSPNPLSVGDIQKVLAKLLKEKVSIRNLVTIFETLADYGKLTTDSDMLTEYVRQALAKQITAQYAKENETLKVVTCSGRVEKAVAEGIQQTEHGNFLSLEPTLSENIIQSVAREIEQLSLRQEVPILLCSPPVRMYVKQLLERYFPDLPVLSYNELEANVEVQSIGVVDIQ

SEQ ID NO: 5959 - protein, 370 aa, Bacillus licheniformis
MKIKKFVAGSMQEATKQIIQELGNDAVILNSKKIQKRKFLGFVKKTGVEVIAVVDQDFSDARKQERQKPVFREQSPSPVPQPDHLDLASQVKELKELLEMRHHEQPVDVLPEPLKKADQLLAKKGVSPAIRTKALGRLISTSLRDGEEWTDEKTLAHLTDALADLLPDNLEQDVAIHSQYVVLFGSTGVGKTTTLAKLAASSVLEKQKKIAFITTDTYRIAAVEQLRTYAELLNAPLEVCYTKEEFKAAQQKFADFDHVFIDTAGRNFKDGQYVRELKEIIPFERKIQAFLVMSATSKYEDMKELIKQFSSIPIDQLIFTKVDETDSLGSVMNLLAESRIGLGYITNGQNVPEDIRYLSNAAFVRLLTGC

SEQ ID NO: 5960 - protein, 295 aa, Bacillus licheniformis
MDQAESLRRRMGQRFAEPPAAIAHPKAKTLAVMSGKGGVGKSNVSLNTALAILEKGKSVLLIDLDVGMGNIDILIGRQSLYTVMDLLQQKMPFERALSAGPRGLQYISGGTGLDAMFELNRENWAFFLKELTRALTSFDYVIFDMGAGLSKDQLPFVLSADEILVVTTPEPTSIMDAYSAIKHLALTGRDLQLKVVVNRCTTQKDGISAFLRLSNTVNAFLQQKLAYAGPIPEDPLVSRAVVEQQPFLIKNPRSKPSRAVYLLAESLLHNGRTEMGENRSFIEKLSSFLRRGNTL

SEQ ID NO: 5961 - protein, 357 aa, Bacillus licheniformis
MIRVLVVDDSAFMRNMITKFLTSNHEIAVAGTARNGEEALQKIKELRPDVITLDIEMPVMNGKETLKRIMASDPLPVVMVSSLTQQGADITIECLELGAIDFVAKPSGSISIDLYKVRDMLIEKVLTAGRVKLKGRQVPISKPAIETAKQPIVGGSDSVRFRAGKQLICIGTSTGGPRALQRVLPKLPKTLKAPVFIVQHMPKGFTASLANRLNHLSEVTVKEAENGERAKDGWVYIAPGGKNMAVGLEKGELVITLDDRDTESRHKPSVDYLFQSLASLREFEKIAVIMTGMGSDGTEGVKGLLKHGSGTVIAEAAESSVVFGMPKSVINNGLANDIKHVDEIAAAIMTYMKKERA

SEQ ID NO: 5962 - protein, 673 aa, Bacillus licheniformis
MDMNQYLDVFIEESREHLQTCNEKLLELEKNPTDLQLVHDIFRAAHTLKGMSATMGYEDMAHLTHSLENVLDAIRNEEMTITSEWMDVMFEALDDLEAIVLSIIEGGDGKRDVSEVCAKLDVTGANKEAAAAAEAPEAASSETKWSYDEFQRTVIAEAEEQGFKCFEIKVALKEDCLLKGVRVYMVFEQLNEVGEVVKTIPETEVLESEDFDSEFVICFLSKHGKEEIFNKINGVSEIEKIEVTELKNDFSAQEEAKPAASEKETAPKEAEKKPAKQPDGKKDAAKPAAGGGTKTIRVNIDRLDSLMNLFEELVIDRGRLEQIAKELEHSELTETVERMTRISGDLQSIILNMRMVPVETVFNRFPRMVRQLTKELNKKIELSIFGAETELDRTVIDEIGDPLVHLLRNSLDHGIEAPEVRVKNGKPETGQVRLKAYHSGNHVFIEVEDDGAGINRKKVLEKALERNVITEREAETIEDHEIDALIFAPGFSTADQISDISGRGVGLDVVKSKLESLGGSVSIKSSEGEGSLFSIQLPLTLSIISVLLVKLENETFAIPISSIIETAVIDKKDILQTHDREVIDFRGHIVPVVYLKEQFNVEDSSDDLDQLHVIVVKKGDKLTAFVVDSFIGQQEVVLKSLGDYLTNVFAISGATILGDGQVALIIDCNALIK

SEQ ID NO: 5963 - protein, 158 aa, Bacillus licheniformis
MTTQTTTGEKMIVFKVNHKEYAISVSEVMSIEKWQQPTRVPGVEPYICGVINLRGVVTPVIDLRKRIEAPGDTITDETRIIIITHQDIEVGWVVDEANDVITVEEEEIESAPETVGKDGRQWIKGIVKQGSRLLNLIDSEAVLNRKSSLAAASENVKK

SEQ ID NO: 5964 - protein, 209 aa, Bacillus licheniformis
MSVFNGIREEHLDILREVGNIGAGHSASALALLLNRKIEMEVPFVKLMSFDELVNLFGGADLPVASIFLRMEGDFPGSMFVIMPFSEAEQLIRELVGNPEFEIDSMTPNDIGASALHELGNIMAGSYLTALADLTNRQMYPSVPELTLDMFGAVISEGLIELSQVGDQVIVIDNSIFDEEHNRKVKAHLFLLPDYDSFEKLFHALGAAL

SEQ ID NO: 5965 - protein, 168 aa, Bacillus licheniformis
MKILEKETSIIRVGIADVKIVRTPDKIRTSGLGSCVGLVLYDLEAKTAGLVHVMLPDSSLSKTPDINVAKYADTAVEATVKMLLEAGCRKYALKAKMAGGAEMFKFKMTNDLMKVGPRNVLAIKKHLSLLNIPIVSEDTGGNSGRTIEFDPQSAELVIRTVKQGVTTI

SEQ ID NO: 5966 - protein, 254 aa, Bacillus licheniformis
MQSLNYEDQMLWSRWKEWKDPQAGDDLIRRYMPLVTYHVGRIAVGLPKSVHKDDLVSLGMLGLYDALEKFDPGRDLKFDTYASFRIRGAIIDGLRKEDWLPRTSREKTKKVEAAIEKLEQRYLRNVSPSEIAAELGMSEQDVVTTINEGFFANLLSIDEKLHDHEDGENVQVMIRDDKTSTPEEKMLKDELISQLAEKINELSEKEQLVISLFYKEELTLTEIGQVLNLSTSRISQIHSKALLKLKHLLDKVVQ

SEQ ID NO: 5967 - protein, 170 aa, Bacillus licheniformis
MSTILWLVSFTLHGILIYFVIILNTRLSAFKAAEKEQKQLLEETENTLTAFLMELKDENEKLVQEIRANAEKEPQRPETQPEIPAQTPVLPEADESRDLPLHIEAMINEVEQEEDELNQKEQEASISYEEEALALYEKGLSPEEIARQLKSGKTEIELFLKFRGKLKNDS

SEQ ID NO: 5968 - protein, 246 aa, Bacillus licheniformis
MSVISMKQLLEAGVHFGHQTRRWNPKMKRYIFTERNGIYIIDLQKTVKKVEEAYNFTKNLAADGGKILFVGTKKQAQDSVKEEAERSGMYYVNQRWLGGTLTNFETIQKRIKRLKDIEKMQENGTFDVLPKKEVVQLKKELERLEKFLGGIKEMKELPDALFIIDPRKERIAVAEARKLNIPIIGIVDTNCDPDEIDVVIPANDDAIRAVKLLTSKMADAILEAKQGEESAETEAKEAETTETTTA

SEQ ID NO: 5969 - protein, 293 aa, Bacillus licheniformis
MANPAQMVKELREKTGAGMMDCKKALTETDGNMDKAIDLLREKGIAKAAKKADRIAAEGLTLIKTDGNTGVILEVNSETDFVAKNEGFKELLNDLADHILAEKPESVEAAMGQKMANGSTVEEYITSAVAKIGEKITLRRFAVLTKGDDAAFGAYLHMGGKIGVLTVLNGTTDEETARDIAMHVAAVNPRFISRDQVSEEEANREREILTQQALQEGNPENIVAKMVEGRLNKYFEEICLLDQAFVKNPDEKVKQVVAAKNATVETFVRYEVGEGIEKRQENFAEEVMNQVKK

SEQ ID NO: 5970 - protein, 240 aa, Bacillus licheniformis
MEKPKYNRIVLKLSGEALAGEQGNGINPTVIQSIAKQVKEIAELDVEVAVVVGGGNLWRGKTGSDLGMDRATADYMGMLATVMNSLALQDSLETLGIQSRVQTSIEMRQVAEPYIRRKAIRHLEKKRVVIFAAGTGNPYFSTDTTAALRAAEIEADVILMAKNNVDGVYNADPRTDETAVKYEKLSYLDVLKDGLAVMDSTASSLCMDNDIPLIAFSIMEEGNIKRAVLGEQIGTIVRGK

SEQ ID NO: 5971 - protein, 185 aa, Bacillus licheniformis
MSTQVMNETKERMQKAISAYQRELATVRAGRANPSLLDKVAVEYYGAQTPLNQIASITVPEARMLVITPYDKTALGDIGKAIQKADLGVTPSNDGNIIRITIPPLTEERRKELAKLVKKYSEDAKVAVRNIRRDANDDLKKLEKNGEMTEDELRSSTEDVQKLTDEYVSKIDEITKDKEKEIMEV

SEQ ID NO: 5972 - protein, 260 aa, Bacillus licheniformis
MLNILKNWKNQHSAASNMECYTKENILKGEIPEHIAIIMDGNGRWAKKRAMPRIAGHHEGMKVVRQTTKLANELGVKALTLYAFSTENWKRPKLEVDFLMKLPEEFLGTYLPELVEENVRVRMTGDREGLPPHTIRAVEKAIRDTENNDGLILNFALNYGGRAEIVRAAKKIAEEAKKGTLNTEEIDEKLFSDYLMTETLQDPDLLIRTSGEIRLSNFMLWQLAYSEFLFTDVLWPDFKDVHLLQAIGEYQRRGRRFGGI

SEQ ID NO: 5973 - protein, 267 aa, Bacillus licheniformis
MKQRILTGVIAAAVFLPLVIFGELPFTLLVYAIGILALFELLRMKGLKLISAPGIISMLLLAVLLCPSQYAEDAGLGITKGEVVFLAVLLLLAYTVLSKNSFTFDEAAFVALAAVYIGFGFYYFIEIRNIGLSYVFFAIGVVWSTDSGAYFIGKAFGKRKLWPEISPNKTVEGFWGGILTAVVFSAIYQAATGFPHAYLFVLIITVLLSIVGQIGDLAESAFKRHYQVKDSGRILPGHGGMLDRFDSFLFVMPVLYFLLVLFQPFGL

SEQ ID NO: 5974 - protein, 383 aa, Bacillus licheniformis
MKNICLLGATGSIGEQTLDVIKAHDDKFRLTAMTFGKNAEKAAEIIETFKPKYVGVGDEHTYETLKQHSFSYTFKTGIGEEALIEAAVIPEADIVVNALVGSVGLLPTLKAMEHKKTIALANKETLVTAGHIVKEHAQKYDVPLLPVDSEHSAIFQALQGENPKHIKRLIVTASGGSFRDRTRRELEGVTVEEALNHPNWSMGAKITIDSATMMNKGLEVIEAHWLFDLPYDQIDVLLHKESIIHSMVEFHDRSVIAQLGTPDMRVPIQYALSHPERLPFNEAKSLDLWEVGQLNFAQADFERFRCLQFAYESGKIGGTMPTVLNAANEEAVAAFLSGRISFLGIEDIIEKALERHQVIAKPSLQEIREVDKDARKFVQTLLT

SEQ ID NO: 5975 - protein, 419 aa, Bacillus licheniformis
MNTVIAFILIFGTLVFFHELGHLILAQRAGILCREFAIGFGPKIFSFKKNETVYTIRLLPIGGFVRMAGEDPEMIEVKPGYTVGLLFDSENKVEKIIINQKEKYPDALVIEVEQADLEHQMRITGYEHGNEDHLSSFSVSETSFFIVDGEEVQIAPYNRQFHSKTVWQRIKAIAAGPIMNFILAYVILVMLGLMQGVPSDEPVLGKLIDNGRAAEAGLQEGDRIQTINGENMRSWTDIVNTVREHPEKELKIVLMRDNVKLTKYVTPEAVKAGDETVGRFGAYNPVKTGVLTSISYGATETATVAQSIVTNLGKLVTGQFSIDMLAGPVGIYDMTDQVAKTGVINLLKLAAFLSINLGIVNLLPIPALDGGRLLFLFIEAIRGKPINREKEAFVVFIGVAFLMLLMLVVTWNDIQRLFL

SEQ ID NO: 5976 - protein, 572 aa, Bacillus licheniformis
MRQSRTLIPTLREVPADAEAKSHQLLLRAGFIRQNTSGVYSYMPLANKVIHKIQSIVREEMEKINAVEMLMPALQQAETWQESGRWYTYGPELMRLKDRHGREFALGATHEEVITSIVRDEVKSYKRLPLTLYQIQSKFRDEKRPRFGLLRGREFIMKDAYSFHSSAESLDETYNDMYQAYTNVFTRCGLNFRPVIADSGAMGGKDTHEFMALSDVGEDTIAYSDQSSYAANIEMAEVKETDAGEQAEMKELQEVHTPSVKTIEEVAAFLGISPSDCIKSMLMKADGRFVLVLTRGDHEVNDVKVKNLLQAEIIEFASAEEVAEITGTEPGFVGPVGLDREIEIFADFAVKAMANAAAGANKTDYHYQNVNISRDAHNVTFADLRFIQEGDPSPDGKGTIRFAKGIEVGQVFKLGTRYSEAMDATYLDENGRAQPMLMGCYGIGISRTLSAIVEQHHDDKGLIWPLEVTPYDLHILALNMKNDAQVQLAEKLYEEFKANGYDVLFDDRAERAGVKFADSDLIGLPIRITVGKRADEGVVEVKIRKTGESFEIAADELFDFIEKQVKSLSSHS

SEQ ID NO: 5977 - protein, 1438 aa, Bacillus licheniformis
MEDQLSVNRRQFQILLQQLNVTEDTMIRHLEGGQIIKLTVHKNKKTWHFHFKLRNVLPYQIFERFHSQLTRTFSHIAQVTCSIEAENPSIDEQLVQDYWTRCIQELDGISPPILALLNDQKPKLTGNKILLKTKTDTEASALKKKYSSLIQSSYRTFGFPELQLDTEIFVSDQEIQKFREQKMAEDQERALQALIEMEKQDKEAQDDEAPAGPLQIGYQIKDSEEIRTLDSIMDEERRITVQGYVFDAETRELKSGRTLCIFKITDYTNSILVKMFAREKEDAVLMKSLKKGMWVKARGSIQNDTFVRDLVMIANDVNEIKAKTREDTAPEDEKRVELHLHSPMSQMDAVSSIGKLVEQAKKWGHPAIALTDHAVVQSFPDAFAASKKHGVKMIYGLEANLVDDGVPIAYNPVHRLLEEETYVVFDVETTGLSAVYDTIIELAAVKVKGGEIIERFERFANPHRPLSATIIELTGITDDMLKDAPEVEEVIRDFKEWVGDHTLVAHNASFDIGFINVAYKRLLNSEKVQNPVIDTLELGRFLYPEFKNHRLNTLCKKFDIELTQHHRAIYDTEATGYLLVKMLKDAAEKNILYHDQLNENMGQSNAYQRSRPYHATLLAVNETGLKNLFKLVSLSHIHYFYRVPRIPRSQLEKYREGLLIGSACDKGEVFEGMMQKSPEEVEDIASFYDYLEVMPPEVYRHLLQLELVRDEKALKEIIANITKLGEKLNIPVVATGNVHYLNPEDKIYRKILVSSQGGANPLNRHELPNVHFRSTDEMLEAFSFLGEEKAKEIVVKNTRMISERIEEIKPIKDDLYTPKIEGADDEIRRMSYEKARSIYGEDLPEIVEKRIEKELKSIIGHGFAVIYLISHKLVKRSLDDGYLVGSRGSVGSSLVATLTEITEVNPLPPHYVCPDCRHSEFFNDGSVGSGFDLPDKDCPKCGAAYRKDGHDIPFETFLGFKGDKVPDIDLNFSGEYQPHAHNYTKVLFGEDNVYRAGTIGTVAEKTAYGYVKGYANDNNLHMRGAEIDRLVQGCTGVKRTTGQHPGGIIVVPDYMDIYDFSPIQFPADATDSEWKTTHFDFHSIHDNLLKLDILGHDDPTVIRMLQDLSGIDPKTIPTDDPEVMKIFQGTESLGVTEEQIGCKTGTLGIPEFGTRFVRQMLEDTKPTTFSELVQISGLSHGTDVWLGNAQELIHNNICELSEVIGCRDDIMVYLIYQGLEPSLAFKIMEFVRKGKGLTPEWEEEMKNNNVPDWYIDSCKKIKYMFPKAHAAAYVLMAVRIAYFKVHHPLLYYAAYFTVRADDFDIETMIKGSTAIRAVMDDINSKGLDASPKEKSLLTVLELALEMCERGFSFQKVDLYRSSASEFIIDGNSLIPPFNSIPGLGTNAALNIVKAREEGEFLSKEDLQKRGKVSKTIMEYLERHGCLESLPDQNQLSLF

SEQ ID NO: 5978 - protein, 654 aa, Bacillus licheniformis
MKQKAFLKMKALCLALLVIFSMSIASFSEKTRAASAEEYPHNYAELLQKSLLFYEAQRSGRLPENSRLNWRGDSGLEDGKDVGLDLTGGWYDAGDHVKFGLPMAYSAAILSWSVYEYRDAYKESGQLDAALDNIKWATDYFLKAHTAPYELWGQVGNGALDHAWWGPAEVMPMKRPAYKIDAGCPGSDLAGGTAAALASASIIFKPTDSSYSEKLLAHAKQLYDFADRYRGKYSDCITDAQQYYNSWSGYKDELTWGAVWLYLATEEQQYLDKALASVSDWGDPANWPYRWTLSWDDVTYGAQLLLARLTNDSRFVKSVERNLDYWSTGYSHNGSIERITYTPGGLAWLEQWGSLRYASNAAFLAFVYSDWVDTEKAKRYRDFAVRQTEYMLGDNPQQRSFVVGYGKNPPKHPHHRTAHGSWANQMNVPENHRHTLYGALVGGPGRDDSYRDDITDYASNEVAIDYNAAFTGNVAKMFQLFGKGHVPLPDFPEKETPEDEYFAEASINSSGNSYTEIRAQLNNRSGWPAKKTDQLSFRYYVDLTEAVEAGYSAEDIKVTAGYNEGASVSELKPHDASKHIYYTEVSFSGVLIYPGGQSAHKKEVQFRLSAPDGTSFWNPENDHSYQGLSHALLKTRYIPVYDDGRLVFGHEPGY

SEQ ID NO: 5979 - protein, 704 aa, Bacillus licheniformis
MDNKTRFMQLYEQIKNPNNGYFSPEGIPYHSVETLICEAPDYGHMTTSEAYSYWLWLEAMYGRYTQDWSKLEAAWDNMEKYIIPVNEGDGNEEQPTMNYYNPSSPATYAAEHPYPDLYPSALTGQYPAGNDPLDAELKATYGSNETYLMHWLLDVDNWYGFGNLLNPSHTAVYVNTYQRGEQESVWETVPHPSQDNQTFGKPNEGFMSLFTKENQAPAPQWRYTNATDADARAVQAMFWARQWGYSNTNYLEKAKKMGDFLRYGMYDKYFQEIGSAADGSPSRGAGKNACHYLMAWYTAWGGGLGQYANWAWRIGASHVHQGYQNPVASYALSTAEGGLIPNSSTARSDWEKALKRQLELYTWLLSSEGAVAGGATNSWNGNYSAYPQNVSTFYEMAYTEAPVYHDPPSNNWFGMQVWPLERVAELYYIFAEKGDKSSESFHMAKHVIEKWIAYSLDYVFVGERPVTDEEGYYLNDAGERVLGGQNPQIAVQSDPGEFWIPANLEWSGQPDPWKGFDSFTGNPGLHVTTKNPSQDVGVLGSYIKTLVFFAAGTKAETGGFTALGNKAKNLAKELLDAAWSKNDGIGIAAEEEHEDYIRYFTKEIYFPNGWSGRNGQGNTIPGPNTVPSDPAKGGNGVYISHAELRPKIKNDPMWPYLENKYQTSWNPNTGKWENGLPTFVYHRFWSQVDMATAYAEYDRLIGNA

SEQ ID NO: 5980 - protein, 560 aa, Bacillus licheniformis
MREKWLALCLKSIILFVLIMGTVLLSAVPKASGTSGPAKQEKQSIITPADLLENMSPGWNLGNTLDAVPTEGSWNNPPVREHTFDDIRDAGFKSVRIPVTWDSHIGSAPEYPIDTDWMNRVEEVTDWALEREFYVVLNIHHDSWLWISRMGNSQQETLDKLGKVWKQIAERFKNKSERLLFEIVNEPTGMSAYQMNLLNREMLNIIRSTGGKNGQRLVIVGGLEDNKDELLHSFEPPDDDRIVLTYHYYSPWDYVSNWWGRTTWGSAAEISEMEEDIKPVYEKFVREGYPVIIGEYGTLGANEKHSKWLYHDTFVRLAHKYQMVPMWWDNGNDQFDRAERQWRDPVVKEIVIQAGRGVPNAIIKPADLFIKKGQSISDQTVDIQLNGNVLTGIYQKSEPLKEGSDYTVDNAGKTVSIKASCLAKLLNGAGQPGVKAQLTFTFHKGASQVMDIILYDDPKLEKSEFTISQSAISGDLKIPASLNGTKLATVKGVVDSTGRPVLEEVWSWTPYLNYDEDFYEKDGDLYLKERVLKYLKSDSTFTFELWPKGVEAVVKVKITP

SEQ ID NO: 5981 - protein, 395 aa, Bacillus licheniformis
MMTKKGLLTVLMPFLLALSAIQFGNPRPALAASPFVETAGTSFTLNGKEFYFAGTNNYYFHYKSKKMVDDVFEDMKAMNLKVIRIWGFLDGQPQENTVMQPRPGIYDESGFSKLDYAIYKAGQTGIKLVIPFVNNWDDFGGMNQYVRWFQADGHDAFYTHPDIKEAYKNYVSYMLNRVNTYNGVKYKDDPAIMAWELANEPRVQSDRTGNTLVEWADEMSEFIKSIDQNHLVAVGDEGFYHIEGHPDWHYNGGEGVDWKRLTALKHIDYGTYHLYPDHWGKTAEWGNQWITDHICDGKEIGKPVVLEEYGYQDKSRRDYVYRTWLELIEKQSGAGSQFWILTGIQDDGTLYPDYDGFRIVYPSSAASVISEHAERMNEKSAASEMLQTKRCHDLQ

SEQ ID NO: 5982 - protein, 157 aa, Bacillus licheniformis
MSNKVIDTVSEMVQPILDNLQLELVDIEFVKEGQSWFLRVFIDSDDGVDIEECAKVSEALSEKLDEADPIKQNYFLEVSSPGAERPLKKEADFMKALGKNVYIKTYEPIEGNKEFEGELSAFDGENVEVTVMIKTRRKTINIPYDKVAKARLAVSFN

SEQ ID NO: 5983 - protein, 372 aa, Bacillus licheniformis
MSSELLDALTVLEKEKGISKDIIIEAIEAALISAYKRNFNQAQNVRVDLNRDTGSIRVFARKDVVDEVYDPRLEISIEDAVNINPNYIVGDVVEIEVTPKDFGRIAAQTAKQVVTQRVREAERGVIYSEFIDREEDIMTGIVQRIDNKFIYVSLGKIEALLPVAEQMPNEVYKPHDRIKVFITKVEKTTKGPQIYVSRTHPGLLKRLFEIEVPEIYDGTVELKSVAREAGDRSKISVRTDNPDIDPVGACVGPKGQRVQAIVNELKGEKIDIVHWSNDPVEFVANALSPSKVLDVIVNEEDKATTVVVPDYQLSLAIGKRGQNARLAAKLTSWKIDIKSETDARELGIYPRELEEEEPEELFLESETPESDE

SEQ ID NO: 5984 - protein, 91 aa, Bacillus licheniformis
MKSRKKIPLRKCVVTGEMKPKKELIRVVRSKEGEVSVDPTGKKNGRGAYLTLDKDVILTAKKRNSLANQLQAQIDDQIFDELLELAEKENR

SEQ ID NO: 5985 - protein, 100 aa, Bacillus licheniformis
MSESEWFSLLGLANRARKVVSGEDLVVKEIRHSRAKLVLLADDASANTEKKVTDKCRHYDVPVKKVGDRVLLGRSIGKESRVVVAVTDQGFANTLLRKLD

SEQ ID NO: 5986 - protein, 716 aa, Bacillus licheniformis
MAKMRVYEYAKAINVSSKDIIAALKDMNIEVNNHMAMIEENAIKQLDQKFKKSAKPAGNKKDAGTGGQKPQQEAAKLNAGSKPNKNRDGKKNNVQNTQFNNKNKKKNNNNKKNKRGKNHQSPQEKQFKPKKELPEKIEFTNSMSVGALAEELGKEPSEIIKKLMLLGIMATINQDLDKDTVELIASEYGVEVEEVIVHEETEFEKYEEPDNEEDLEIRPPVVTIMGHVDHGKTTLLDSIRKTKVVEGEAGGITQHIGAYQIEENGKKITFLDTPGHAAFTTMRARGAEVTDITILVVAADDGVMPQTVEAINHAKAAEVPIIVAVNKIDKPTANPDRVMQELTEHGLVPEAWGGETIFVPLSALSGEGIDELIEMILLVSEVEELKANPNRRAKGTVIEAELDKGKGSVATLLVQNGTLHVGDPIVVGNTFGRVRAMVNDVGRRVKSAGPSTPVEITGLNEVPNAGDQFLVFKDEKTARSVGEARATKQLEEQRSDKAKLSLDDLFEQIKQGDVKEINLVVKADVQGSVEALAAALQKIEVEGVRVKIIHTGVGAITESDIILASASNAIVIGFNVRPDGNAKSTAEAENVDIRLHRIIYKVIDEIEAAMKGMLDPEYEEKVIGMVEVRQTFKVSKIGTIAGGYVTEGTITRDSGIRLIRDGVVIFEGEVDVLKRFKDDVKEVSQGYECGITIKKYNDIREGDMIEAYVMQEIERK

SEQ ID NO: 5987 - protein, 92 aa, Bacillus licheniformis
MIGFVECECIIYDASSLKEKRAVLKRIITRIRAKFNVSVSEIDYQDTWQRTSFGIAAVSSSRVQTEKELQRVLAFIDSFPEIERTITRTEWF

SEQ ID NO: 5988 - protein, 117 aa, Bacillus licheniformis
MTMRATRVGEQMKKELGDIIGRKLKDPRIGFLTVTDVRVSGDLQIAKVYISVLGDEKKREETLKGLAKAKGFIRSELGNRIRLRKTPEIHFEFDESIDYGNRIETLIHELNANKEES

SEQ ID NO: 5989 - protein, 309 aa, Bacillus licheniformis
MYNGVLLLHKPVGMTSHDCVMKIRKLLKTKKVGHTGTLDPEVSGVLPICVGRATKIVEYLTEKSKTYDAEVTLGCSTETEDQTGEVTEKKPVLAPPDEQTVQSVLRSLEGTIEQVPPMYSAVKVGGKKLYEYARAGIEVERPKRTITIHHIELTSEIRHEGDKARFRFVVTCSKGTYVRTLAVTIGEKLGYPAHMSNLVRTASGPFTLDECLTFEDVEGLIADGTLSEKLVPIERALDHLPKWIISDTLAKKVENGAVLETPGSFSHLTSEDRIAVFTEAGRCTAVYYPHPTKTGLLKPAKVHVQKSEQ

SEQ ID NO: 5990 - protein, 319 aa, Bacillus licheniformis
MKTIHISHPHDLKREDFPTSVMALGYFDGVHLGHQQVILTAKNTAAREGVKTSVMTFHPHPSAVLKKGREPKDLITPLQDKISIIEDLGVDFLYVVTFTPEFASLSPEEFIDQYILGFHVTHVVAGFDFTFGKFGKGTMENFQEYAKGRVKSTSVAKYSNQDQKVSSTRIRSVLGAGDVEYAAELLGRPYHVKGFVIHGDKRGRTIGFPTANIGLKDTYIVPPTGVYAVKAEIGGAVYNGVCNVGYKPTFYEKRPGQPSIEVNLFDFDRDIYGSEIKVEWYKRLRSEKKFGSVDELVEQISRDKEEAIRFFRERKPAGI

SEQ ID NO: 5991 - protein, 89 aa, Bacillus licheniformis
MAITQERKTQLINEFKTHESDTGSPEVQIAILTDQINNLNEHLRTHKKDHHSRRGLLKMVGKRRNLLTYLRNKDVTRYRELINKLGLRR

SEQ ID NO: 5992 - protein, 705 aa, Bacillus licheniformis
MGQEKHVFSIDWAGRKLTVETGQLAKQANGAVMVRYGDTAVLSTATASKEPKTVDFFPLTVNYEERLYAVGKIPGGFIKREGRPSEKAILASRLIDRPIRPLFADGFRNEVQVVSIVMSVDQDCSSEMAAMFGSSLALCVSDIPFEGPIAGVTVGRVDNKFIINPTLEQLEKSDIHLVVAGTKDAINMVEAGADEVPEEIMLEAIMFGHEEIKRLIAFQEEIVAAVGKEKSEITLYEIDSDLKEKVRGMAESNLLKAIQVHEKHAREDAISEVKNEVLAKFEEEEHDEETLKQVKDILSQLVKNEVRRLITEEKVRPDGRAVDEIRPLSSEVGLLPRTHGSGLFTRGQTQALSICTLGALGDVQILDGLGVEESKRFMHHYNFPQFSVGETGPMRGPGRREIGHGALGERALEPIVPSEKDFPYTIRLVSEVLESNGSTSQASICASTLAMMDAGVPIKAPVAGIAMGLVKSGDNYTVLTDIQGMEDHLGDMDFKVAGTSKGVTALQMDIKIEGLSREILEEALQQAKKGRMEILESMLSTLAESRKELSPYAPKILTMSINPDKIRDVIGPSGKQINKIIEDTGVKIDIEQDGTIFISSTDESMNQKAKKIIEDLVREVEVGQLYLGKVKRIEKFGAFVELFSGKDGLVHISELALERVGKVEDVVKIGDELLVKVTEIDKQGRVNLSRKAVLREQKEKEEQKS

SEQ ID NO: 5993 - protein, 320 aa, Bacillus licheniformis
MKGTIVRISVFFFLLLMSYQMMNRPYSQHYIDAMKKDAVTVAAQKDDLYQELLQKAPEYEVKAQNAKIDHIWKAMPGYNGLKVNIEKSYKKMKQAGEFDEKLLVYDQVKPDVHLESLKPEPIYRGHPDKPMVSFIINVAWGNEYLEEMLPVLQQHRIKATFFLEGRWVKHHPELAKAIQNGGHEIGNHSYNHPDMSKLTRERISEQLRMTNEQIQETLGVKPKWFAPPSGSFRKEVVDQAHKMGMGTIMWTVDTIDWQKPQPAVLQQRVLSKVHNGAMILMHPTDPTAKSLAVLIQNLHEKGYQIGTVSQLMNEKRLVEE

SEQ ID NO: 5994 - protein, 409 aa, Bacillus licheniformis
MIKRYTCQNGVRIVFENNPTVRSVAIGVWIGTGSRHETPEINGISHFLEHMFFKGTKTRTARDIAESFDRIGGQVNAFTSKEYTCYYAKVLDEHASYALEVLSDMFFHSSFDEEELKKEKNVVYEEIKMYEDTPDDIVHDLLSKASYGSHSLGYPILGTEETLAEFDGDSLRKYMNEYYTPDRVVISIAGNVPETFIKEAEKHFGSYEAKGKRTGMTKPDFHHEKMTRKKETEQAHLCLGFNGLEAGHPEIYDLIVLNNILGGSMSSRLFQDVREDKGLAYSVFSYHTSYEDSGMMTIYAGTGANQLQLLSETIHETLRALKSDGITPKELENSKEQMKGSLMLSLESTNSKMSRNGKNELLLGKHRTLDEIIEKLNAVSLERVNNLANRIFTDDYSSALISPSGELPK

SEQ ID NO: 5995 - protein, 86 aa, Bacillus licheniformis
MRLSELSGKEIVDVKRAERLGVLGQTDLEINEQDGQITALIIPSVKWFGLGRKQGNDIKVPWSQIQKIGSDMIILDVPESSVTKEE

SEQ ID NO: 5996 - protein, 299 aa, Bacillus licheniformis
MLTGLTIAIIGGDARQLEIIRKLTEQDAKVFLIGFDQLDHGFTGATKLKLNELDFGTIDSIILPVSGTSMEGTVATVFSNEKVVLKQEHLEKTKPHCAIYSGISNQYLDGMAKGANRRLIKLFERDDIAIYNSIPTVEGAIMMAIQHTDFTIHGSNVMVLGLGRTGMSISRTFSALGARVKVGARDSAHLARIMEMGLTPFHTNELAEHVENIDICINTIPSLILDKHVLSRMTPRTLILDLATRPGGTDFDFAEKQGIKALLAPGLPGIVAPKTAGQIIANVLCNLLSELTTDRKGLS

SEQ ID NO: 5997 - protein, 196 aa, Bacillus licheniformis
MSIKGKRIGFGLTGSHCTYDAVFPQIEALINKGAEVRPVVTHTVKSTDTRFGEGEEWVRRIEELTGFEVIDSIPKAEPLGPKTPLDCMVVAPLTGNSMSKLANAQTDSPVLMAAKATMRNSRPVVLGISTNDALGLNGVNLMRLMAAKNVYFIPFGQDDPYKKPNSLVAKMDLLVPAVEEALSHKQIQPILVHNDQ

SEQ ID NO: 5998 - protein, 346 aa, Bacillus licheniformis
MGRGLHVAVVGATGAVGQQMLKTLEDRNFELDKLTLLSSKRSAGTKLTFKGEEYTVEEARPESFEGVNIALFSAGGSVSQALAHEAVKRGAIVIDNTSAFRMDQNTPLVVPEVNEEDLHKHNGIIANPNCSTIQMVVALEPIRKAFGLNKIIVSTYQAVSGAGNEAVKELYGQTEAILNDKPFEPEIMPVKSDEKHYQIAFNAIPQIDKFQENGFTFEEMKMINETKKIMHMPELQVSATCVRLPIATGHSESVYIETDRDDVTAEDIKNLLKEAPGVVLQDDPAKQVYPMPADAVGKRDVFVGRVRKDLDRPNGFHLWIVSDNLLKGAAWNSVQIAESLKALNLV

SEQ ID NO: 5999 - protein, 404 aa, Bacillus licheniformis
MKIIVQKFGGTSVKDDRGRKLALNHIKEAVNEGYKAVVVVSAMGRKGDPYATDSLLDLLYGGQDTITEREQDMLLSCGETISSVVFASMLLENGIKAAALTGAQAGFLTDNNHTNAKILEMKPERLVSMLADHDAVVVAGFQGATAKGDITTIGRGGSDTSAAALGAALDAEFIDIYTDVEGVMTADPRIVEKAKPLPVITYTEICNLAYQGAKVIHPRAVEIAMQAKVPIRVRSTYSNETGTLVTSHHNSKAGSDVFERLITGIAHVKDVTQFKVPAKEGQYNVQTEVFKAMANAGISVDFFNITPSEIVYTVAGNMTDRAHSILKELGYEPAVTRNCAKVSAVGAGIMGVPGVTSKIVTALSEKGIPILQSADSHTTIWVLVHEKNMATAVNALHEVFELSK

SEQ ID NO: 6000 - protein, 297 aa, Bacillus licheniformis
MNHDEVKKMNFGNIATAMVTPFDKNENIDFQKLSKLIDYLLNNGTDSLVVAGTTGESPTLSEEEKVALIQYSVKEAAGRAPIIAGTGSNNTKASIKLTKKAEEAGADAVMLVTPYYNKPSQEGMYRHFRAIAEETSLPVMLYNVPGRTAASLAPETTIRLAEIPNIIAIKEASGDLDAITKIVAETPEDFAVYSGDDSLTLPALSVGARGIVSVASHIIGPEMQEMIKHYTEGNTAQAALIHQKLLPLMKGLFAAPNPSPLKTALQLKGLDVGSVRLPLIPLNEDERLRLSSLMNGL

SEQ ID NO: 6001 - protein, 554 aa, Bacillus licheniformis
MKKNTENIRIIALGGVGEIGKNLYVIEIDSDIFVVDAGLMHPENEMLGIDVVIPDISYLIERSDRVKAIFLTHGHEENIGGVFYCLNKLSVPVYGTKLTLALLKETLKQYGVNKKPDLREIHSKSVITFESTKVSFFKTNHSIPDSVGVSFKTSLGSIVCTGDFKFDQTPVLNQTSDIGEIAKIGNSGVLCLLSDSANAEKPGYTPSEALVGGEISDVMYNAENRVIIAVFASNFNRIQQVIDAALQNGRKLAVSGKNISAILQLAMKLGYVTADEDMFIPVQEVKKYPKREVAILTGDNHGEPLAALTRIAKQGHKQLDIEEGDTVLIASSPIPGQELVYSKAVDLLTRAGAQVVFAQKRVHVSGHGCQEELKLMLNLLKPKYLIPVNGEYRMQKAHSKLAEEIGMKRSDIFLIEKGDVVEFRGQNVKIGDKVHSGNILIDGLGVGDIGNIVLRDRRLLSQDGILIVVITLDKKKKHLVSGPEIITRGFVYVRESEQLIVEATELVRELVNESTENAVVEWSALKQTMREALNQFLYEKTKRKPMIIPIIMEV

SEQ ID NO: 6002 - protein, 248 aa, Bacillus licheniformis
MDSNRIQNGDSQGEQPAKQDAKDSLVNKIQQLGETTLPQMGQDTNIHCLTIIGQIEGHVQLPPQNKTTKYEHVIPQIVAVEQNPKIEGLLIILNTVGGDVEAGLAIAEMLASLSKPTVSIVLGGGHSIGVPIAVSCDHSYIAETATMTIHPVRLTGLVIGVPQTFEYLDKMQERVINFVTSHSNISEEKFKELMFSKGNLTRDIGTNVVGNDAVKYGLIDETGGVGQAIQKLNELIEQNKGAQEGMIQ

SEQ ID NO: 6003 - protein, 71 aa, Bacillus licheniformis
MILYKKMPQEIVFAGQAENSNLKQIDVNGVPLLVEMNGEEARVVQVLSTNPMDFLKQETAPGQTLKLTFYK

SEQ ID NO: 6004 - protein, 781 aa, Bacillus licheniformis
MAKRKRKSTKKQKQGKKRIHLKFELYGLICIAISIIAVLQLGVAGQTFIYMFRFFAGEWFILCLLGLFLTGLSLFWKKKTPSFLTRRKAGLYCIIASMLLLSHVQLFQHLTERGMVQSPSVIQNTWELFLMDVKGETGSPDLGGGMIGALLFAASYFLFASAGSKIIAVFLILIGLLLITDRSLQETLIKWMTPVASFMKNQWQAFLADLKQLKNSSPKKKSGKKQKTQRKPKVSEEPVQEADLDPDPVIQSEPIISSFSDRDEKPEVQAYEAPAAPAEPPAEPEIGEEMQASGAPEITFTELENKDYQLPSIQLLDDPKHTGQQADKKNIYDNARKLERTFQSFGVKAKVTQVHLGPAVTKYEVYPDVGVKVSKIVNLSDDLALALAAKDIRIEAPIPGKSAIGIEVPNAEVAMVSLKEVLESKLNDRPDAKLMIGLGRNISGEAVLAELNKMPHLLVAGATGSGKSVCVNGIITSILMRAKPHEVKMMMIDPKMVELNVYNGIPHLLAPVVTDPKKASQALKKVVNEMERRYELFSHTGTRNIEGYNDYIKRMNAAEEAKQPELPYIIVIVDELADLMMVASSDVEDSITRLSQMARAAGIHLIIATQRPSVDVITGVIKANIPSRIAFSVSSQTDSRTILDMGGAEKLLGRGDMLFLPVGANKPLRVQGAFLSDEEVEKVVDHVISQQKAQYQEEMIPEETQETVSEVTDDLYDEAVALVVSMQTASVSMLQRRFRIGYTRAARLIDAMEERGIVGPYEGSKPREVLLSKEQYEELSS

SEQ ID NO: 6005 - protein, 241 aa, Bacillus licheniformis
MSIKADNQRLCLKVIDRIKDDIQNGVFCENERLPSEFELSKMLGVSRTALREALRILEEENVIIRRHGVGHFVNARPLFLSGIEQLNSVTKMIEQASMTPGTIFMSSQVTAPTEEDMLRFQYAEETEIFLLERVRTANGMPVVYCLDKIPVDILPEGFSHEQESMFEWLENKSGAVISYAVADIVPIGYHDTISQILECDPETSLLLLKQTHYDQNDKPVLYSLNYFRADKFRFHVVRKRF

SEQ ID NO: 6006 - protein, 401 aa, Bacillus licheniformis
MKSIFALSSVPLVMTLGNSMLIPVLPVIEKKLNISSFQVSLIITVYSIVAIVCIPITGYMSDRFGRKKIMLPCLLIAGAGGALAGLASTFFNDPFAMILAGRVLQGIGSAGAAPIVMPFIGDLFQNDEEISAGLGDIETANTAGKVLSPILGAFLASWVWYMPFWFIPVVSLASFFLVLFFVPKPKDKDDEKQTLKNFAKSVQEIFKREGRWLVSTFVIGGIIMFLLFGVLFYLSDTLEKKHQIDGIAKGALLSIPLLFLSVSSYLAGKLIGNDKIRMRICVLIGMILLALSFAGLWWNHSFYPLFLFMSIGGIGIGIALPSLDALITEGIEKEERGTISSFYNSMRFIGVALGPPVFAYMMTNAGWLIFIVSLLCSLAALALVLFNIDPKEDESEAAKTV

SEQ ID NO: 6007 - protein, 426 aa, Bacillus licheniformis
MTYLNEIKGKHRGLTSHIVKTEKFKTVSIIFKMLAPLTKEDVTKRALFPHVLLRGTSTRPKTAELRSYLDELYGTSVSCDLSKKGEMHVITFRLDIANEKFLKDQTPLLEKGLELLSEIIFSPALEDGAFLPLYVSQEKRTLKQRIQAVYNDKMRYSNLRLIQEMCKDEPYALHVNGELDDVDGITPQSLYEAYQKAVSEDQLDIYVVGDVDEQQVDSYISKYFEANERELRPVPELEQTRTREPQEVIEDADVKQGKLNMGFRTGTHFTDDDYPALQLFNGLFGGFSHSKLFINVREKASLAYYAASRIESFKGLLMVMSGIEVGNYQKAVDIIKEQFQEMKKGSFTEEAIDQTKAVIKNQILETLDTPYGLVEFIYQQAAAQTEFSLEDWLGRIDNVTKEDIIEVGKKIDLDTTYFLKGTEGAS

SEQ ID NO: 6008 - protein, 428 aa, Bacillus licheniformis
MTKTIEFEQLKETLYYEKMPGGLDVYVLPKEGFNKTYAVFTTKYGSIDNQFVPLGKDEMVRVPDGIAHFLEHKLFEKEDGDVFQQFSRQGASANAFTSFTRTAYLFSSTSNVEENLETLVDFVQDPYFTEKTVEKEKGIIGQEINMYDDNPDWRLFFGLIENMYQEHPVRIDIAGTIESISHITKDLLYECYETFYHPSNMLLFVVGPADPEAIIRQVRENQQKKPYTDQPEIVRKEVKEPGAVFKKEQEIKMNVQSSKCLVGLKSAHPMNTGEALLKHELTINLILECLFGKSSSDYERIYEKGYIDETFSYDYTEEHGFGFVSVGGDTPEPDKLAEELKQVLFKAKETITAEKLELARKKKIGNFLKSMNSPEYIANQFTRYAFLETSLFDIVTVLESITLDDVHRVIEEEVEEDRITVCKVVPKS

SEQ ID NO: 6009 - protein, 85 aa, Bacillus licheniformis
MTKLALITGASGGIGQSISEKLAQNGYDLLLHYHTNEKAAASLAERLSHTYGIHAEIIHGDLSDPGGAKTVSASIGGRALDGIVF

SEQ ID NO: 6010 - protein, 36 aa, Bacillus licheniformis
MVQLHVSSPFLLTRESASGDDQEKVRRYCSRQLYLG

SEQ ID NO: 6011 - protein, 85 aa, Bacillus licheniformis
MSVLDNWDQWKNFLGDRLNYAQEQGMSKETISDLAYEIGDYLAGEVDSKNHQERVLADLWSVASEEEQRAIANVMVKLVENNSSH

SEQ ID NO: 6012 - protein, 263 aa, Bacillus licheniformis
MAKLEWYLEYEIQVNRPGLLGDISSLLGMLSINIVTINGVDTQRRGLLLKCRHIDQIKRLESILNTMDTIKVTKLREPKLRDRLAVRHGRYIQRDADDKKTFRFERDELGLLVDFMAELFKKDGHKLIGIRGMPRVGKTESIVASSVCASKRWLFVSSTLLKQTIRSQLIADEYSPENVFILDGIVSTRRGSERHLQLVSEIMRLPATKVVEHPDIFVQNTEYTMDDFDYIIELRNSPDEVITYEHAEEPQMFDHSGFSGFDF

SEQ ID NO: 6013 - protein, 300 aa, Bacillus licheniformis
MTELGNRLKEAREEKGMSLDDLQAATKIQKRYLTALEEGNYDIIPGKFYVRAFIKQYAEAVGLDSEHLFEEFKKDIPNSYNDEVSEKLSSIKPQRELPKSASKALELLPTLLVAAGVIVVIAIIYVIVQAVNGGGNQQAEGPKTEESQSKYDVSKDSPLTKENQQNTDAQKDSAEGDKEKKDQQSDENDKLTIKATASEGSSTTYEVSGSDKLELEVKASENSWVRVRDEKGSSLKEGMMKKGETFQKNITDQSQIDLRIGYAPGVEIKINGEVLSYKLDPKTVMTQNITIQNKKEEKSS

SEQ ID NO: 6014 - protein, 193 aa, Bacillus licheniformis
MFNLPNKITLSRIALIPVFMVIMLVPFQWGAVSFGSESIPVTHLIGALLFIFASVTDWVDGYYARKLNLVTNFGKFLDPLADKLLVSSALIILVHYHLAPAWMAIVIISREFAVTGLRLVLAGTGEVVAANMLGKVKTWAQIIAISALLLHNLPFELVSFPFGSLALWVAVFFTVVSGWDYFAKNWDALKTSN

SEQ ID NO: 6015 - protein, 416 aa, Bacillus licheniformis
MKLERKAEIIAVGSELLLGQIVNTNAQFISRHLAEIGINVFYHTAVGDNPERLKQVIQTAQQRSDFIIFSGGLGPTKDDLTKETIAEVVGRPLKLDDEAFESIQDYFKKTNREMSPNNRKQALILEGSDVLPNRFGMAPGMLLEHESRFYMLLPGPPKELEPMFENEAKPLILEKLGSREKIVSRVLRFFGIGESQLETDLEDLIDAQTNPTIAPLAADGEVTLRLTAKHADPEETNRLLKETEDRILERVGEFFYGYDDTSLAEELAKACRSKGMTLAAAESFTGGLFSSWLTEMSGASEYFKGGAVCYTNELKVSAAGVSEDTLQRYGAVSAQCAKELAAGIRVKTGSDIGISFTGVAGPNTQEGHPAGKVFIGISVKDQAEEAFEFQFAGSRSAVRKRSAKYGCHLLLKMMEK

SEQ ID NO: 6016 - protein, 348 aa, Bacillus licheniformis
MSDRQAALDMALKQIEKQFGKGSIMKLGEQTETRISTVPSGSLALDAALGVGGYPRGRIIEVYGPESSGKTTVALHAIAEVQQQGGQAAFIDAEHALDPVYAQKLGVNIDELLLSQPDTGEQALEIAEALVRSGAVDIVVIDSVAALVPKAEIEGDMGDSHVGLQARLMSQALRKLSGAINKSKTIAIFINQIREKVGVMFGNPETTPGGRALKFYSSVRLEVRRAEQLKQGNDVMGNKTKIKVVKNKVAPPFRTAEVDIMYGEGISKEGEIIDLGTELDIVQKSGAWYSYQEERLGQGRENAKQFLKENKDILLMIQEQIREHYGLDTGGAAPAQEDEAQAQEELEF

SEQ ID NO: 6017 - protein, 519 aa, Bacillus licheniformis
MSPLAILISILLSLFCLVVGYYVRKIIAEAKISGARNAAEQILGDAKRDAEALKKEALLEAKDEIHTLRIEAEQEVRERRNELQKQENRLLQKEENLDRKDESLDKREAMLEKKDHSLNERQQHIEEMESKVDEMIRMQQSELERISSLTRDEAKQIILERVENELSHDIAIMMKESENRAKEEADKKAKNILSLALQRCAADHVAETTVSVVNLPNDEMKGRIIGREGRNIRTLETLTGIDLIIDDTPEAVILSGFDPIRRETARIALDKLVQDGRIHPARIEEMVEKSRREVDDYIREMGEQTTFEVGVHGLHPDLIKILGRLKFRTSYGQNVLKHSMEVAFLTGLMASELGEDVTLAKRAGLLHDIGKAIDHEVEGSHVEIGVELATKYKEHPVVINSIASHHGDQEPTSIIAVLVAAADALSAARPGARSETLENYIRRLEKLEEISESYEGVEKSFAIQAGREVRIMVKPDSINDLEAHRLARDIRKRIEDELDYPGHIKVTVIRETRAVEYAK

SEQ ID NO: 6018 - protein, 265 aa, Bacillus licheniformis
MRILFIGDVVGSPGRDMIKTYLPKLKLKYKPNAVIVNGENAAHGKGITEKIYHQLIQAGADVLTMGNHTWDKREIFDFIDDAPQIVRPANFPEGTPGKGITYIKTNGSKELAVINLQGRTFLPAIDCPFRKADELIEEASKRTPFIFIDFHAEATSEKQAIGWYTDGRVSAVVGTHTHVQTADNRILPKGTAYITDVGMTGPYDGILGVDRETIIKRFKTSLPVRFEIAEGRTTLSGVVIDIDEQSKKAVKIDRILINDDHMFFE

SEQ ID NO: 6019 - protein, 86 aa, Bacillus licheniformis
MEILKVSAKSNPNSVAGALAGVLRERGAAEIQAIGAGALNQAVKAVAIARGFVAPSGVDLICIPAFTDIQIDGEERTAIKLIVEPR

SEQ ID NO: 6020 - protein, 80 aa, Bacillus licheniformis
MKIFDAHSDLLLKLWKNPKLNEYSDPSLQTPVQALLNGKAKVQCLAIFLPETVPDTIRLEMALMQIQLFHEKIAKYKRIN

SEQ ID NO: 6021 - protein, 159 aa, Bacillus licheniformis
MTSYGERLIRKANKNRAWTDLSHLSEKSFWGAIETAAYPIASHSNARSLCPHPRNLKDDQIKALIDKNGVIGLTFVPEFVRNGKTPVIKDILSHIDHVCSLGGERHIGFGSDFDGIDRVIPNLEAHKDYGNLIEALQRSYTPSQVDGFLFQNFISRIPF

SEQ ID NO: 6022 - protein, 346 aa, Bacillus licheniformis
MDGNMKALIKKPGEPGASFELVPIPKIDKHEVLIKVKAASICGTDVHIYNWDEWAKSRVKPPYVFGHEFSGEVVQVGENVTTVKEGEYVSAETHIVCGKCLPCLTGKEHVCKKTLILGVDTDGCFAEYVKMPAANIWKNPAGMPEDLASIQEPLGNAVHTVLTGMTAGVKVAVVGCGPIGLMAVAVAKASGAAQVIAIDKNEYRLDLALQMGATDIISVEKEDPLKNVSALTNGEGADLVCEMSGHPTAIRQSLKMAANGGRVHVLSLPEHPVCIDMTNDIVFKGLTVQGITGRKMFETWRQVSGLLQSGTIQIKPVITHRFPMEEFEKGFELMRKGQCGKVVLIP

SEQ ID NO: 6023 - protein, 391 aa, Bacillus licheniformis
MKEFNFLASELNTMKENGTFQELPIIESMQGSTVKMKGKDIIQLSSNNYLGLTSHPRLQKAAEEAVKRYGAGTGSVRTIAGTFTMHDELEKKLASFKNTEAALVFQSGFTANQGILSSILTKDDLVISDELNHASIIDGIRLTKAGKKVYQHADMEDLEKILKKSMNYRMRLIVTDGVFSMDGDIAPLPEIVRLAEQYDAFVMVDDAHASGVLGENGRGTVHHFGLDGKVHIQVGTLSKAIGVLGGYAAGSKVLIDYLKHKGRPFLFSTSHPPAVTAACIEAVNVLMEEPSLIKKLWDNTAYFKKELEKIGLPLIKSETPITPILIGDEAEACRFSNTLFELGLFAQAIVFPTVPKGKARIRTIMTAQHSKEELDKALEIIQTGAKKAGLL

SEQ ID NO: 6024 - protein, 509 aa, Bacillus licheniformis
MNEKQRIESGQVNPSDKKSEKDYSKYFEAVYVPPSLKDAKKRGKEEVKYHNDFKISEQFRGMGEGRKFYIRTYGCQMNEHDTEVMAGIFMALGYEPTDSTEDANVILLNTCAIRENAENKVFGEIGHLKALKKDNPDLILGVCGCMSQEESVVNRILKKHPFVDLIFGTHNIHRLPELLSEAYLSKEMVIEVWSKEGDVIENLPKVRTGKIKGWVNIMYGCDKFCTYCIVPYTRGKERSRRPEDIIQEVRRLAAEGYKEITLLGQNVNAYGKDFEDMEYGLGHLMDELRKIDIPRIRFTTSHPRDFDDHLIEVLAKGGNLLDHIHLPVQSGSSDVLKLMARKYDRERYLELVAKIKKAMPNASLTTDIIVGFPNETDEQFEETLSLYREVEFDSAYTFIYSPREGTPAAKMKDNVPMRVKKERLQRLNEVVNEISAKKMKEYEGQVVEVLVEGESKNNPDILAGYTRKNKLVNFKGPKEAIGQLVNVKIHQAKTWSLDGEMVGEAIEVK

SEQ ID NO: 6025 - protein, 143 aa, Bacillus licheniformis
MTLYTKKEIVAKARELAKMIAETEEVDFFKKAEAQINENAKITGIINQIKALQKQAVNFKHYEKHEALKQTEAKIDALQEELDEIPIIQEFRDSQMEVNDLLQLVAHTISNQVTNEIITSTGGDLLKGETGSKVKNSSPSCSL

SEQ ID NO: 6026 - protein, 182 aa, Bacillus licheniformis
MSEYREIITKAVVAKGRKFTQSTHTISPSQKPTSILGGWIINHKYDAEKIGKTVEIEGTYDINVWYSYADNTKTEVVTERVSYVDVIKLRYRDKNYLDDEHEVIAKVLQQPNCLEVTISPNGNKVVVQAEREFLAEVVGETKVVVEVNSDWTESDEEEAWEEELDEELEDINPEFLVGDPEE

SEQ ID NO: 6027 - protein, 869 aa, Bacillus licheniformis
MAGYTPMIQQYLKIKAEYQDAFLFFRLGDFYEMFFEDAKKASQELEITLTSRDGGSSERIPMCGVPYHSCSSYIEQLIKKGYKVAICEQVEDPKSAKGVVKREVVQLITPGTVMDGKGIHENENNFIASVSKFQHTYGLAFSDLTTGENLVTAIERLDDVVSEIYSVGAREIVVSRNLDEKDVAMLKERCGATISFEDEQADEVPGIVNGLGSKELVDTFMRLYVYLKRTQKRSLDHLQNVQAYELEEAMKIDLYSKRNLELTETIRSKNKKGSLLWLLDETKTAMGGRLLKQWIDRPLIRKGQIEERQEIVETLIAHLFEREDLRERLKEVYDLERLAGRVAYGNVNARDLIQLKESLKQVPAIKQLVGSLDHPKAKARAEKIDPCGDLLNLLEDALYENPPLSLKEGNLIKDGYHAKLDEYRDASKNGKDWIARLEQQEREYTGIRSLKVGFNKVFGYYIEVTKANIHLLEEGRYERKQTLTNAERYITPELKEKEALILEAENNICELEYELFSELRSKVKEYIPRLQQLGKMMSELDVLQCFATISENRHYVKPEFSDDVVQVIDGRHPVVEKVMDSQSYVPNSCEMGKGRQMLLITGPNMSGKSTYMRQMALISILAQIGCFVPAKKAVLPIFDQIFTRIGAADDLISGQSTFMVEMLEAKNAIVHATKNSLILFDEIGRGTSTYDGMALAQAIIEYVHEHIGAKTLFSTHYHELTSLEEKLDDLKNVHVRAEEYEGKVVFLHQIKEGAADKSYGIHVAQLAELPDGLISRAKTILKELESGAKEAAPSTAPNMVKEAAEEAAATVADQPAQLSFFETDKPIEKETKLSKKEQAVLAEFKAMDLLDMTPIQVMNELYRLQKKLK

SEQ ID NO: 6028 - protein, 636 aa, Bacillus licheniformis
MAKIVQLPDDLSNKIAAGEVVERPASVVKELVENAIDANSSVIEIDVEEAGLASIKVLDDGEGMDAEDCRTAFLRHATSKIKDENDLFRVRTLGFRGEALPSIASVSHLSIKTSTGEGAGTHLTLQGGRIISEQKAPSRRGTEITVTNLFFNTPARLKYMKTIHTELGNITDVVNRIALAHPEVSIRLRHQGKTLLQTNGNGDVRHVLAAIYGTAVAKKMLPLEARSLDFEVKGYIALPEITRASRNYMSSVVNGRYIKNFPLVKAIHEGYHTLLPIGRHPITFIEINMDPLLVDVNVHPSKLEVRLSKETELHELIRDAIKDVFKQQQLIPSVQVPKKTAPLINKPEQQKLDFDQVREPAPLSDSDVEREYKPEPSFSAMKLSSLVKDPPPSAPVEREENVMQDTEPEWPGAEEYTPEAAPAVQAEPEQAGENVQDEETPKERVPIMYPIGQMHGTYILAQNENGLYIIDQHAAQERIKYEYFREKVGEVESEVQDLLVPLTFHYSKNEALTIDQHLDDLAKVGVFLESFGAGSYIVRCHPTWFPKGEETTIIEDIIQQVLDDRTIDIKKLREEAAIMMSCKGSIKANHHLRDDEITALLDELRRTSDPFTCPHGRPIIIHYSTYEMEKMFKRVM

SEQ ID NO: 6029 - protein, 93 aa, Bacillus licheniformis
MHYITACLNIISDKDLNEIMKEFKTLEEKTNKEEGCIQFHAYPLEPSERKIMLWEIWENEEAVKAHFTKKHTKDVQNQQLTEVEWLIKSNVND

SEQ ID NO: 6030 - protein, 175 aa, Bacillus licheniformis
MKGYKKLGSVDVTDEIGTGKDFIGGSYMLYSNGQIVRKYISGGEVKYELVSRIPESRVKKSNIEKALDWAKDTVGELSGGYDGYRAITGVDPVTGEKLTVTDRILSGVSVIPATKVVKVGKYAFKATKGAKTAKRVSNAERSANATPKINRKQALNQAKDLAGNNLHVNGRLAMI

SEQ ID NO: 6031 - protein, 49 aa, Bacillus licheniformis
MVVTHTNDNRLHAHAGKPDKEANQFNYDFKKERYTNIYGPNGDHHIYYK

SEQ ID NO: 6032 - protein, 145 aa, Bacillus licheniformis
MNARKSMKEFTCLELLDFEEFDSPWIDLFEPLLKQFRRIDSKPTYYKLIGDSKENNILWIENSLSFLKQKKEWFIVVPKCLQPVWANVRVLDYSKAIHELWEMSEPDNFLIADKSTGMIAKIFFEEQQYEIHIGKCSLDNIKKNN

SEQ ID NO: 6033 - protein, 328 aa, Bacillus licheniformis
MPITKKKIPVAILTGYLGAGKTTLLNRILTEKHNQKIAVIVNEYGEVGIDNQLVVDSEEEILEMNNGCICCTVRGDLIRILRTLVFSMDQGKVAFDRVLIETTGLADPAPVAQTFFMDELLSEIFEVDSIVTVVDSKHVTRHLDDQDEAQEQIAFADVIILNKTDLVSNNELKSLEQRLVNINPTAKRLYARDCKVNLRDILGINTFDVNRKIEIDPHFLEDHHHHHHDDKVSSIAFREEKPLDLAKVDHWMSYLVREKGEDLLRYKGILYIKGEEYRIVFQGLHMLFSGRPDRKWNENEKKQSELVFIGKDLDKEELERQFKNCIAK

SEQ ID NO: 6034 - protein, 128 aa, Bacillus licheniformis
MATWDLSNMKHHIFICNGSSCNRAGAEELTQVIRQEISDRELDDFIHTTRTRCNGRCQDKCVAIHYPRGTWYRDLKPEDVPLLIDSLCTNEDYKEKASHLYDGQRFERSSGVISGVPKEKVIKVSKKF

SEQ ID NO: 6035 - protein, 164 aa, Bacillus licheniformis
MHNINIRKAISADLPFILTIYNQGIEDRIATLEQDLKEMSDIEIWFQEHQGRYSVLVAESKGEIVGWASLNPYSHRCAYQGVADLSVYVDRACRGKGIGGLLLQALEKTAKENSFYKIVLFTFPFNELGQNLYNKMGYRQVGIFKNQGILDGRFIDVMAMEKLL

SEQ ID NO: 6036 - protein, 215 aa, Bacillus licheniformis
MFKTKFKKTIGIGLVAAACLISASTASAASQNESDVKVKLDDQQRNQYTVKSFHYLTVDGKNVDSPAQANAKSVRDVKVTMVLPKQNKNGDLLAYGFTSKVTLEAFIAKDKQRLEKQFKPSASGPCCTDFYEYKNKGGQYIYWRDGFKNLPSSWNDRISSLSTASPSSSYSTTLWEHTSTQGYGKGVLFRHSDWYGKTANMASDWDNKASAIDIK

SEQ ID NO: 6037 - protein, 36 aa, Bacillus licheniformis
MSGGYGHGSGFALIVVLFILLIIIGASWFGGGYGGY

SEQ ID NO: 6038 - protein, 107 aa, Bacillus licheniformis
MSGLIAASLLKNAGHRVTIVEANDRAGGRVFTSRAPFSEGLYFNAGPMRIPDIHTLTMEYIKKFNLPVNVFINRTPMDILYVNGVKTRLHEFEKNPGVLRFPVAPHE

SEQ ID NO: 6039 - protein, 246 aa, Bacillus licheniformis
MNAARDRNIMLLLLCLTAGIVDVIGYLSIGHVFTANMTGNIVLLGLSIGNSLHATAVYSLIALFGFIIGVIISAAIVGKQEKSFWPTGVTIALAVEAAVLLLFACLTFFESSPHLLILLLSIAMGLQTTAARKLGIAGISTTVLTGTLANFFEDVTKRFLSNNNQKVIHKDAWLRALTIVLYCLGAVIAALAEPEHPFVVIWIPIVIIIGIIAVQAQGFTERVRDDQIRTVLYTGIREPSIVTYVL

SEQ ID NO: 6040 - protein, 489 aa, Bacillus licheniformis
MEHINMEQFILLAALLLIIGVLTTKFSTRLGVPALVLFLIVGMIMGSDGLGIIYFNNPELAQLIGIIALVVILFEGGLQTKWSSVKAVAVPSLSLATIGVLLTTCVVAVAAKLIFNVSWMEGFLFGAIVGSTDAAAIFAVLKGQNIRDRLSSTLEAESGTNDPMAMFLTLSLIQLLTADHSSYFMLVISFFWQMGMGLLLGYLLGRFASFAINKINLDSSGLYPIFALAFALLTYSLTDVIGASGLLAVYIAALVIGNQDLTYRHSIFRFNEGFAWMMQILMFIILGLLVFPAQFLSFDIIFKGFLLSLILIFIARPVAVFLSTIKMGFNFNEKIFLSWAGLKGAVPIVLATFPMTMGLENSQLIFNVVFFVVLTSALIQGSTISVFAEKLKLNGPQKVEAPHSLELVSIGKANAEIIEFEVDDQAAITRQMLKDISFPKDALINAIIRNGDLVTPHGETKIKPGDILYILVSKKQKKELKKFLNREFD

SEQ ID NO: 6041 - protein, 81 aa, Bacillus licheniformis
MKMMKRSIGTFEIDGLTIEYSRVGEGKPILVMHGGHSNCREEFGYRDLYESRFSIITPSRAGYGRTSKEIGDSLELACYYI

SEQ ID NO: 6042 - protein, 103 aa, Bacillus licheniformis
MIIVTTDTIANQNIVEVKGLVTSSIVQSRNIGKDILSGLKSVIGGELKNYTQMLEDSKKAVRERLVNQAEELGANAIVGLRFELSAGQGTSELIGYGTAVVIG

SEQ ID NO: 6043 - protein, 216 aa, Bacillus licheniformis
MIRKLFTIIIMASIIAVGFVCKDSWLDVIRDGGVYSVLFSMLLVAACVFFPIVPFALIAGLNGALFGIANGVLITLTGSMLGTMLLFFLSRYGFRDMARRHLTKYPKMSEYEAYFNQNAFTAVLLGRLIPVIPAVVMNIVCGLSKVKWAVFFAASTLGKVPNVLVVSIAGANFSENKLLSVGVYGLYMAIIAFVIYRKYPHLTQKHKETKQTGKPS

SEQ ID NO: 6044 - protein, 338 aa, Bacillus licheniformis
MVYTAEHLDDYLMEQASNNHFHGSILLADSNGILLSKGYGYANCKDKVKNEPSTRYQIASLTKQFTAIAVMQLQEKGLLRTDDPVQNYLEGYPNGDSITIKHLLSHTSGIPDFLEEELLDIELERAPLDQFIRRFIDKPLEFRPGQRFNYSNSGYILLTKIIETITNEAYGDVIQQLIFDPLGMKNSGFFSSPEDISPTVGYLCLNREMIKAPIVYGYGESGLYSTVEDLYLWDRALYTEKLVSKDALKEALYSRVKKQAFAAEGPSPALIQNNSIGYGWFINHQNKYKIWHDGEIHGFISSINRYMDEKKVLIMLSNCNLSKTDEILAHLEEALLQM

SEQ ID NO: 6045 - protein, 396 aa, Bacillus licheniformis
MGHKHIAIFNIPAHGHINPTLALTASLVKRGYRVTYPVTDEFVKAVEETGAEPLNYRSTLNIDPQQIRELMKNKKDMSQAPLMFIKEMEEVLPQLEALYENDKPDLILFDFMAMAGKLLAEKFGIEAVRLCSTYAQNEHFTFRSISEEFKIELTPEQEDALKNSNLPSFNFEDMFEPAKLNIVFMPRAFQPYGETFDERFSFVGPSLAKRKFQEKETPIISDSGRPVMLISLGTAFNAWPEFYHMCIEAFRDTKWQVIMAVGTTIDPESFDDIPENFSIHQRVPQLEILKKAELFITHGGMNSTMEGLNAGVPLVAVPQMPEQEITARRVEELGLGKHLQPEDTTAASLREAVSQTDGDPHVLKRIQDMQKHIKQAGGAEKAADEIEAFLAPAGVK

SEQ ID NO: 6046 - protein, 525 aa, Bacillus licheniformis
MSNQGNFKKTISLLDLILIGMGAIFGSAWLFAVSNVASKAGPAGSFSWIIGGVIILLIGLVYAELGAALPRTGGIIRYPVYTHGHLVGYLISFITIVAYTSLISIEVTAVRQYVAYWFPGLTIKGSESPTIIGWLLQFALLCLFFLLNYWSVKAFAKSNLIISVFKYFVPLTIIIVLIFHFKSANFAGEFAPFGFGGVQTSISTGGVMFAYLGLHPIVSVAGEVKNPQRNIPVALLICIIVSACVYTILQVVFIGAIPTDMLNDGWKAIGREFSLPFKDIAVLLGMGWLATLVVLDAILSPGGNGNIFMNTTSRLVYAWARNGTLFKIFAKVNKPTGIPRPSLWLSFALAVFWTLPFPSWDALVNVCSVALILSYAIAPVSAAALNVNAKQLKKPLQIKGMAVIAPVSFIFASYIVYWSGWNTVSWLLGSQLVMFAVYCACKKYVPQDDVSFAQQLKSSWWIVGYYVMLLILSFLGSFGNGLGLLRTPVDLILIALGSIAVFYWAKYTALPKAVIDYDEKKEETV

SEQ ID NO: 6047 - protein, 99 aa, Bacillus licheniformis
MNEFIQNMTGMGAMTEQVIATDFLISAKTGVKNIATAITETSSPEVRETLKQYLNDAIDTHEQITNYMISKGYYHPANLSEQIQIDTKAAETAKDLPQL

SEQ ID NO: 6048 - protein, 68 aa, Bacillus licheniformis
MRLNNAIHETLELHELLMFKNLCLTKSSTMTGMVQDQELRDILERDASQTKHQIEHLQGLLSVRGETV

SEQ ID NO: 6049 - protein, 419 aa, Bacillus licheniformis
MFIYTVQPGDSLFVIGAKFGISIDQIRLANGLIATNIVPGQALLIPLYTYTVQPGDSYYTIARRTFVSVEALQKANPSVTPSNMRPGIKVMIPELPKKPITALGYYTLRNPRLDQELIHNFAPYATYLAFFEYHISSDGSLSELNDSPAVQTAWRRRVPPLMTVTNLTESGFSPSLAHRVLNQPAVRNRLIDNIVQTISRKGYAGVNIDFEQILEEDRDLFSGFLRLLKERLKPSGYVLTIAVPPKTNENIAWLKGYDYGGIGAVSDLIFIMAYDWHHGTSEPGPIAPINEVRQTIQFALRHVPKEKIVLGFPLYGYNWTLPYQPGAVYPGIANQDAVQLAMKHQAPIQYDTNSESPFFRYTDEQGRRHVVWFEDARSIGKKLQLITEYGLDGGGVWQLTLSFPQGTWLLTKFFRVRKV

SEQ ID NO: 6050 - protein, 194 aa, Bacillus licheniformis
MGRSKEFDTALVLHKAMEVFGQFGYEGASMQELLSRLGIARQSLYNAFGTKRGLFIAALTRYLDDKNAQVIAMLESPGSVKQSVRQIFQESLNVLKDPERSKACYIINSAIEQIPRDPEVAEYFDKQTKQLETAFYKALVRAQSQGELKKGLHDLSAVARFLNQTRLSLTFQAKLTGDFDALQDLIDVSLSILD

SEQ ID NO: 6051 - protein, 139 aa, Bacillus licheniformis
MTRAITDVMELFLQSMLEKDMEKWIQLWDQDAVFEHPYAPPVFPKKIEGKSAIYDYIKDFPEKIDIVRFTAPTIHQTAKSGYSAVEFECEGIVCETGLPYNQQYISLVNLKAGKIVHYKDYWNPLTVVKSFGGQLQTFL

SEQ ID NO: 6052 - protein, 281 aa, Bacillus licheniformis
MGKKILITGGTGTTGSRIAKRLVHLGAGVRIASRRIPAITGAEHVYFDWNDQTTYKDALKNTDSLYLVAPVGVYEPSPIVLPFLEMASAFGVRRIVLLSAAIIDENGPVFGKLHHAVRRYVPEWAVLKPSYFMQNFDHQHGASIREKNEIVTASGDGKVGFIDADDIAEVAVRALLDQKPHNTSHILTGPEALSYAEAAAIIGRAAGRDIRHVNVEVSALRTRYIKAGLSPDYAGFMSELDEKIKNGKENRITDTVERITGKKPRSLADFANEHTGRWRLF

SEQ ID NO: 6053 - protein, 101 aa, Bacillus licheniformis
MENAEHLQQTAVPEQHTHIPQYQHPETALHHIKCPLFPHLKHKTLCTVAPFVHYGLNEAQATSYHHAMEEVAAMAYLMGMGMNPHLAYCTVESWEINETFY

SEQ ID NO: 6054 - protein, 151 aa, Bacillus licheniformis
MAKHHFYLQADWPGKRNDIGRIESGNLKTEISIPKEMDGPGAGTNPDEMLLGAAATCYIITLAAMMERSGLEKESLTMESEAVVDVTGGVFTYEKIIHRPLIRLPKEAAQKEAELAERLAKKAETSCMISRAVQGNVAIELEPKIVVSKAD

SEQ ID NO: 6055 - protein, 119 aa, Bacillus licheniformis
MKGMIFLAAAILSEVFGSTMLKLSEGFSAPLPAAGVIIGFAASFTFLSFSLKTLPLSAAYATWAGTGTALTAAIGHFIFQEPFNLKTLIGLTLIIGGVFLLNSKRTEAADQKAQLTIEI

SEQ ID NO: 6056 - protein, 105 aa, Bacillus licheniformis
MIAGYIFLLIAILSEAAAAAMLKISDGFARWQPSVLVVIGYGLAFYMMSLTLQVIPLSLSYATWSGAGTVLTAIIGVLWFQEKLNRRNIAGIICLVSGVVLINLS

SEQ ID NO: 6057 - protein, 87 aa, Bacillus licheniformis
MLVRYHFIIGGIFLCIISTMLLYMTTTASESLAGLSLGGPFGRPFFGPRPFFGPGPFFGGFLGGLTAGALLGPWGYPYPPYPYYPYF

SEQ ID NO: 6058 - protein, 137 aa, Bacillus licheniformis
MNENMTLYQSDWSKAPPHAHAYRARTTTAEGHYHLIEGFSQPANGSNTDGHVHFYSGITSFVDGHYHRYYAITGPAIPRADGTHYHEIEGTTYLAYSAAPPVRYGGVVYVSDGMKERHRHPFKGYTREIVGNEPIGW

SEQ ID NO: 6059 - protein, 314 aa, Bacillus licheniformis
MNKTKPPVIVLIGPTAVGKTKLSVMLAERLNAEIISGDSMQIYKRMDIGTAKIREEEMNGVPHHLIDIKEPTESFSVAEYQEIVRQKIAEIDRRGKLPMIVGGTGLYIQSVLYDYSFTEEAGDPEFRAEMEAFSAKRGAEYVHDLLKERDPEAARAIHPNNKRRVIRALEILHTTGKTMSEHMEGQRKELLYTTALIGLTMEREVLYDRINSRVDQMMDEGLLDEVKLLYDENVRNCQSVQAIGYKELYAHLEGRASLEEAVETLKRNSRRYAKRQLTWFRNQMDVAWFDMTPPVNIEQKKQEIFTYIAGKLEL

SEQ ID NO: 6060 - protein, 73 aa, Bacillus licheniformis
MKSINIQDQFLNQIRKENTFVTVFLLNGFQLRGQVKGFDNFTVLIESEGKQQLIYKHAISTFAPQKNVQLELE

SEQ ID NO: 6061 - protein, 70 aa, Bacillus licheniformis
MKPKIVINHWEETCEDDSCYEYGTSILVNGKELVREASIMTAVQSVLKELGIEADIKEVCENKCCDAYKK

SEQ ID NO: 6062 - protein, 131 aa, Bacillus licheniformis
MIQIVFDSKTGNVQRFVDKTPFRNKRKVSTEEYLDEPFVLITYTTGFGEVPKTTEMFLEKNAHLLLGVAASGNRVWGDNFAKSAEKISKQYQVPILGKFELSGTAKDVELFTQEVERVVTKSSAKMDPVKQ

SEQ ID NO: 6063 - protein, 700 aa, Bacillus licheniformis
MSQNQVPKWIQLNNEIMIQKDGKFQFDKDKEAVHSYFVDYINQNTVFFHDLKEKIDYLIKNDYYEEEFLSRYTFEEIKEVFKEAYAKKFRFPSFMSAFKFYNDYALKTNDKKKILERYEDRISIVALFFANGDKEKAKEFVRMMINQEYQPSTPTFLNAGRKRRGELVSCFLLEVNDSLNDISRAIDISMQLSKLGGGVSLNLSKLRAKGEAIKDVENATKGVVGVMKLLDNAFRYADQMGQRQGSGAAYLNIFHRDINDFLDTKKISADEDVRVKTLSIGVVIPDKFIELAREDKAAYVFYPHTVYKAYGEHLDEMDMNEMYDRLVEDPRVKKEKIHPRKMLEKLAMLRSESGYPYIMFQDNVNNVHANNHISKVKFSNLCSEVLQASQVSSYTDYGQEDEIGLDISCNLGSLNILNVMKNKSLEQTVKLATDSLTHVSETTNITNAPAVKKANKAMKSIGLGAMNLHGFLAQNNIAYESEEARDFANTFFMMMNFYSIERSAEIAKEKGETYHGYEGSAYATGEYFEKYVTQDFSPKFEKVAKLFEGMHIPTKEDWKQLKQFVKEHGLYHSYRLCIAPTGSISYVQSSTASVMPIMERIEERTYGNSKTYYPMPGLAPSNWFYYKEAYDMDMFRVVDMISTIQQHVDQGISFTLFLKDTMTTRDLNRIDLYAHHKGIKTLYYARTKDTGQEGCLSCVV

SEQ ID NO: 6064 - protein, 325 aa, Bacillus licheniformis
MTKIYDAANWSKHEDDFTQMFYNQNVKQFWLPEEIALNGDLLTWKYLGKNEQDTYMKVLAGLTLLDTEQGNTGMPLVAEHVEGHQRKAVLNFMAMMENAVHAKSYSNIFMTLAPTETINEVFEWVKQNKYLQKKAQIIVGLYEKIRQGDKISLFKAMVASVYLESFLFYSGFYYPLYFYGQGKLMQSGEIINLILRDEAIHGVYVGLLAQEIYNQQTPEKKEELYAFSIDLLKELYENELEYTEDLYDQVGLSHDVKKFIRYNANKALMNLGFEAYFEEEEINPIVLNGLNTKTKSHDFFSMKGNGYKKATVEPLKDDDFYFDDK

SEQ ID NO: 6065 - protein, 205 aa, Bacillus licheniformis
MGKMDEMILVVPRENVFANETLTFQGVNSDGETIGKIMAHIERHFSEMRRGDAEEDPAFKQPIPYVVIKREDEIFVYERLEGGGEARLHNKLSLGFGGHMNFAEGLDFPDILKLNTDRELDEELLIEESAKEKMVTLGLINDDENSVGKVHIGILSALELKPGAHVEVKEKEQIAGRWMKASDLKEKSVYDRLESWSQFVVDILV

SEQ ID NO: 6066 - protein, 266 aa, Bacillus licheniformis
MKEPYRMQLESFQMTILSDGAFRVSRDFFLAGGDSKETERYPEEFEAALNFACLETNGKRILIDTGFGETGGQESGHLLHHLKQAGIKPDSIDYVILSHSHLDHTGGLLKNGEPAFPNAVHLLSEAEWLYAKQTPASPQFHILSAVRPLLKLLTEDTELLPGLKLIHTPGHTPGHLTIELHTKDGVCQIINDVFHIPESISNPKLRVSLEHDPIEGEKTRRLLARQAYNGQFLLHGCHFPYPGFGLIEKHGSFFQWKPVLYEKKTR

SEQ ID NO: 6067 - protein, 143 aa, Bacillus licheniformis
MPTLEELYRSVIMDHARYRRNFRKIDKHGVYYVHYKNPTCGDVMTLFIDIKNEKIEDAAFIGDGCSISMASSSIMTELIKGKTLKEAGLMREAMENMIRKGEEPEEDLLGDAVSLIGVHPLRARHNCALMPWQALDRIKENVY

SEQ ID NO: 6068 - protein, 154 aa, Bacillus licheniformis
MENETNVKQEAMAQLKRKGIRMTPQRLAIYHYFLANRNHPTIAEIQQSLREIYPAVSTATIYNTIRYFKQEGLIKEMGFTDPLRFDLALEEHDHVICEVCGKIVDFHCPQLEKVKDIAARLTGFKVTHHRLELYGICNDCQAKRKYAAKEKGVR

SEQ ID NO: 6069 - protein, 220 aa, Bacillus licheniformis
MKNNIKRIKRISLREEVYQTLKRAIVHLELKPEERLHDQELAEQFGISRTPVREALKRLEDEGLVEAVPGSATRVAPLNREEAEHAFTVTAALHALAVRLSLPFLTDSDFDQLEAHNKTLQQAIQKEDIIEAIESDAAFHDVFLQASKNPEITRALERISSKIYRLEMSQFSSIGSLKSVEQHQNIIDACRQGDRNAAIKLAEENWLSLGDRLAGHQEKE

SEQ ID NO: 6070 - protein, 322 aa, Bacillus licheniformis
MRPIILGVFAAFFFAFTFVLNRAMELEGGSWIWSASLRFIFMAPLLFAIVWLRGNVKELFQEIKKAPGIWVRWSIIGFGLFYAPLCFAAAYGPGWLIAGTWQITIISGSLLAPLFYETVQTKTGPVQIRGKIPYKGLTMSFIILIGVALMQAEHAAQLSLHEMLLCIAPVILASFAYPLGNRKMMEVCAGRLDAYQRVLGMTLASLPFWLILSLYGLASAGAPSRGQVIQSGLVAVFSGICATVLFFAATDLVKGDMRKLAAVEATQSFEVLFAAAGEILILSSPLPGAISWSGMALVIIGMVLNSHASNQKPAVQSKAAKA

SEQ ID NO: 6071 - protein, 253 aa, Bacillus licheniformis
MVKIFIDPGHGGTDPGASANGLQEKQLTLQIALALRNILLNEYQNVTVQLSRTSDQTVSLTQRTNAANSWGADYFLSIHINAGGGTGFEDYIYPGVGAPTTTYRDIMHEEILKVVDFRDRGKKTANFHVLRETAMPALLTENGFVDNTSDAEKLKSSAFIQSIARGHANGLARAFNLSKKSTALFKVQIGAFRDKANADSLAAQAKAKGFDAIVIDRDSLYKVQIGAFSSKENAEALVQQAKNAGFDAFIYQE

SEQ ID NO: 6072 - protein, 160 aa, Bacillus licheniformis
MKNKSMYVFLFMMLGLFAGMASPIQTSINSELRNAIHSPFIASLISFLVGMLVLLFLTSFIEHRRLFLNNLQTAKTFVTSSPWWLWTGGILGVVFITSNILLLPIVGASLTVVLALSGQMIIALVIDHFGWFGIPKHRLNVQRILGIVLMITGIMIIQHF

SEQ ID NO: 6073 - protein, 150 aa, Bacillus licheniformis
MMIILILIAGILAGMAIPVQTSINSRLGMKIGSPYGAAAISFFVGTLLLLIVALVTERHFLSIIGLVPSIPWWILIGGGCLGVFYLTSNILLLPRLGSALTVVVTLLGQMIMALAIDHFGWFHVPVHELNFPRIIGILFIISGVFIIKKY

SEQ ID NO: 6074 - protein, 61 aa, Bacillus licheniformis
MIFTIRHTKTFGIPVIVKLTFVFSFATFAIASCTLKFKANTFLNSRFISTYHFYICIKNQV

SEQ ID NO: 6075 - protein, 67 aa, Bacillus licheniformis
MFNEREALRLRLEQLNNAEIQIIRELQSERKDIYSRLRELDRQKVSSSHHKKTLLELVDETVNLLKK

SEQ ID NO: 6076 - protein, 207 aa, Bacillus licheniformis
MGNTDTREELLHIALELFATKGYHAAKISDIVKQAGVAQGTFYWHFKSKEEIAKEIIGRGKDNLLAAIHQGYRQTFALADDMIQSTTALMKRIFTFAQENRNLMTFLLVKGQGADPEIREAIEEALISVEQAFKKNIQRATELGMLNSSHNTDLQATMLTSLVLGTLSKWLFGPKHDLNYVPKFSVDEMTEELVHFEFFGLIGQRGN

SEQ ID NO: 6077 - protein, 128 aa, Bacillus licheniformis
MSTIQKTNGEFGIFHEAGMQAKGSFTPNSDGLTPIELLEASLGMCITISLQKMFERDGIEVLEDEFSVSVSAAKAPEGPSRVEKCSVSVKLPEHLPTDYKKKLITSAERACTIGNTLKRGVTIDTNMV

SEQ ID NO: 6078 - protein, 449 aa, Bacillus licheniformis
MENNSKKPSYTNADDFAVTSVPENKRKSIFNITITSCAWIISLSTIVTGGALIQGLNFAHAVLAAVLGMLILAVYGFFQGVMGAKYGISTTVLARLAFGRYGSSLFGIVLALTLGIGWFGWQVAFFGTTISEMFPGVWLAKPEVAIVWGGILMILTAFIGYRGLAALSFIAVPLVVIFSIWGIISAVNYSGSWHNLLTFHPTGDPLTIFAGITIVVGNAALGAVVFPDVTRYAKGAVSGGIGASVGYFLGGVFCLVAGAAMAIAANVPDIGSTPNIPAAMSKLGLGFLAFLIIVFAQWTTNDNNLYTGSLGLRNVVNIPKKALVAIMGVIGIIIALLGVQNMFVPFLTFLGLYVPPIAGVMIADHWITAPVIKKKQYQFGAGTTYSKLNVAAILSVIIGGFTASKITFGIGPINSTILAFLIYIIFTFIFTKLNLRYEIGEATEESSGF

SEQ ID NO: 6079 - protein, 701 aa, Bacillus licheniformis
MMNEKNQWVFGIDVGGTFTDLVAVNKDGKMVSTKTPSTPDQSDGVMNGIKKMAEIIGIDVKDLLANSPLVVHGTTVATNALLEYNGAKVGLLTTEGFRDEIEFRRAYKESVFSPRLEAPYQIVPRRYRVGIPERLDHTGNVVTKLDEEAVRRAVRGFIQEGVEAVAVCFLFSFMNPSHEIRVKEIIQEEAPGMFVSLSYEVLPQIREFERVSTTIVNAFTGPSMQSYLNHLDERFREDGFTGELFVMQSNGGVQNVIQSGKFAAGGLLSGPAGGVTAASFIGEKSGYENVITVDMGGTSYDVSVIEKLNPAITTENWISRYRVALPMMDIHTIGSGGGSIAWIDSGGALQVGPRSAGSNPGPACYGRGGEEPTVTDVNVFLGYINPDNFLGGEMKLDRSLAEKAIRTRIAEPLGISTVEAALAISQIVNSDMSNAVHFVTTQRGHDPRNFALMAVGGAGAIHAGKQAEDLGIKTVIVPSLAPVFCALGDVAANLKVTELRTRFESLKNVDLQAMNADFEKMEQTAREKLGGQSVTNQYETRRFIDMRYAGEVHEVTVPVKSRTRRITELNLEATAADFHDLHERMFAHKDPEHDIEILNLRLDLVGVREPLKLKEEQFEQEDPSKAKTGERDMYFDIEPAKTPIFNGSMLEPGNLIVGPAIIEQWGTTIVVYPGHEALIDSYRNCVIEVKHAQQATRGGNA

SEQ ID NO: 6080 - protein, 492 aa, Bacillus licheniformis
MIQAQILYRKLQAIGREVGDNLQRISRSPVLSQDRAFAAAIFTNELKIAVQHQYEPEHLFALKESVENLFDYFSFDIADGDVLLVADPYSGGTKGQSLTMAAPLFLEGELVLFPAIRAQMIDLAGEYPGGFHPDAFEVWQENIRITPVKLYKQGVLQTDILRFLLSNSRVPASFKADLEAMYTCLHGAKQQLKTFLGSYGQKTVAASIKSMFEYSQKRVEHHVSHLPETEMSAVQEFEVTKGHKSTIHVQISKKENAVEIDLSGSSEQSVKPVNSPAALTKAFAVWPFLARIADEIPINEGTLQPFQTKTRPGTILDPEFPAATALAPSITGHFVAAAVFKAIQNGQGTSEEFPPIYGPGPQAVFYPELGTGAETKSIVLAPGYPSASKGFGPPALFGQRMLVSAEELELYHGFKMVSREWTDNGEEMEVSLLNQEDDIYFNLLLPFSERGKYGSLSRTGDHDETFYESTVHQHVKKGNLLVFTYSQKEEQL

SEQ ID NO: 6081 - protein, 579 aa, Bacillus licheniformis
MINQDFILSQVVGGSLDAVAREMSATVTRTARSPLFNEAHDFTTGVFDLSGKKSRLVAQAPGCTLHLYAVVGAVDHLLDAFRYDLHPGDILLVNDPYHGGSHSLDWTIVMPVFYNRKPILLPAVRSHMADNGGPVAGGYNPRSKDIWHDGLRIPPLKIYERGEKRRDVFDLIVANNRLSHWLEGDLNAMIGACKVAASRIQTMLDKYGAEKVITAIDNRIQYTENRVRDEISSWPDGTYVGETFADHDFQGNRDIKVRATVTVKGSDLHIDFTGSSPQVKGFINSPLSNTTSFAFVGISTCCDEDIPINEGYMNPVTVTAPIGTVVNPQLPAPCGHATACVGAEIAEAVLQAISQCAPKRVGVNAHKLPLAYSHGKYDDGKPWVNLNFYGYTGGAGAAYETDGWGLYPPVMTGVILPSIEMTEVQYPSRVLKHEYTSDFTGAGRWRGTPGLDVQIQHLKESRTSVMMAGGRNTTKGFCGAGDSPSNKVIVGYGTDEAREIDETAFEVKMPVGGIIQFYRAGGGGWGNPLEREPEKVLDDVLNEFVSIESALQDYGVVIDPETLAINEAETKRVRASRLP

SEQ ID NO: 6082 - protein, 144 aa, Bacillus licheniformis
MKNKKAFWGPFLFGVGIIAMIDGIIFHQLLQWHSVYMDTDRSHQIMSDGLFHLFSLVILFIGGILLWNRGELGSSRPQHIFWGASLLGAGWFNFLEGIINHHLLQIHHVNQLSPNRLLFDFAYDASGLLIILAGWLIYRKGKQG

SEQ ID NO: 6083 - protein, 113 aa, Bacillus licheniformis
MDKKDIKFLEELLYNTDKDDLVRVTRNIENPVILQVFAANYNWNSGFDVPKAILENENCDYGTGLLMFHYADGYRMLESPDNVSASALEEWKDFLIQTYQKLINLQFKSQNIS

SEQ ID NO: 6084 - protein, 63 aa, Bacillus licheniformis
MKNISKYVVLFFGVALFLYFYDMFMPKSVLYFVVGIPALYISTVLIMKTLKLQKIQKINPELK

SEQ ID NO: 6085 - protein, 232 aa, Bacillus licheniformis
MVNVLNNILKNDRLDAYPLFKKFCSLKEKGLRKKSFTALSSFIDEAKKWDDIAQQNFACWLFALFETSDDIHHVLVHPLEKELLQPLLERWMKSDPEDSRPYRWYGVFLNPENRVDYLNNALRLGGGNEQLSLLTLIDINLNALWYSFHHISEDLYLGDIKEDTALLAKSRPLNNKVECEQTRKNNNEALNYYQDLLDDWVMFKKERSKGFVEWCENKGRTYYWVKAYYYER

SEQ ID NO: 6086 - protein, 321 aa, Bacillus licheniformis
MLERAVTYKNNGQINIILNGQKQVLANSEAEAEYQAALQKNEAKHSILKEIEREMNTLVGMEEMKRNIKEIYAWIFVNKKREEQGLKAGKQALHMMFKGNPGTGKTTVARLIGRLFYEMNVLSKGHLIEAERADLVGEYIGHTAQKTRDLIKKAMGGILFIDEAYSLARGGEKDFGKEAIDTLVKHMEDKRNEFILILAGYSREMDHFLSLNPGLQSRFPISIDFPDYSVSQLMDIAKRMMAEREYQFSPEAEWKLKDHLMAVKSTVSPAKFSNGRFVRNLIEKSIRSQAMRLLMGDCYLKNDLITIKSQDLDLKEDAPHV

SEQ ID NO: 6087 - protein, 420 aa, Bacillus licheniformis
MNEQEVMKEKAILVGCQLPHVSDERFSYSMEELAALTKTADGTVVSTVTQKRNRVDAATYIGKGKVDELAVLCEELSPDVLIFNDELSPSQLKALVTTLDVKIIDRTQLILDIFAKRARTREGKLQIELAQLQYALPRLSGQGINLSRQGGGIGTRGPGETKLETDRRHIRNRIHEINVQLSTVIRHRSRYRERRKKNGVLQIALVGYTNAGKSTWFNRLTDADSYEENLLFATLDPMTRKMMLPSGYSVLLSDTVGFIQDLPTTLIAAFRSTLEEVKEADLILHMIDSSHEDYEGHEETVKRLLEELEADDIPVLTVYNKRDRKRPDFIPSSGRGHIMTSAKIDGDLPLFKQAVEDYLKKELLVPYDVRIPASEGRLLSRIKSETMTNSTVFDEDREAYEVEGYILPDQNILGELKKYM

SEQ ID NO: 6088 - protein, 421 aa, Bacillus licheniformis
MFETLKHGDLLKKTAVEAETDIAQIHKTIDEISERNEWRVLESYRKHKVSDTHFTPSTGYGYDDIGRDTLEKIYADVFGGEAALVRPQIISGTHAISIALFGVLRPGEELLYITGKPYDTLEEIVGVRGEENSGSLKDFQIGYSHVELTEEGAVDFDRVAASITPQTKVVGIQRSKGYADRPSFTIDEIEKMIRFVKEINENIIVFVDNCYGEFVEEREPCHVGADLMAGSLIKNPGGGLAKTGGYITGKEKWVKACSYRMTSPGIGSEAGASLYTLQEMYQGFFLAPHVVSQALKGAVFTARFLEKLGFRTNPSWGSKRTDLIQSVEFSTPEQMIAFCQAIQYASPINAHVTPYPSYMPGYEDDVIMAAGTFVQGASIELSADGPIRPPYVAYVQGGLTYSHVKNAICSAVDALMKQGLM

SEQ ID NO: 6089 - protein, 135 aa, Bacillus licheniformis
MSDKIRRSMPLFPIGIVMQLTELSARQIRYYEENGLVFPARSEGNRRLFSFHDVDKLLEIKDLIEQGVNMAGIKQIFAKTENEQKEDKQDKPKKAEKHNLSDEELRKLLKNELIQAGRFQRGTTFRQGDMSRFFH

SEQ ID NO: 6090 - protein, 444 aa, Bacillus licheniformis
MAKYTRDDIVKLVNEENVKYIRLQFTDILGTIKNVEIPVSQLEKALDNKVMFDGSSIEGFVRIEESDMYLYPDLDTFVIFPWTAEKGKVARFICDIYNPDGTPFEGDPRNNLKRILKEMEDMGFSDFNLGPEPEFFLFKLDEKGEPTLELNDKGGYFDLAPTDLGENCRRDIVLELEEMGFEIEASHHEVAPGQHEIDFKYAGAIRACDDIQTFKLVVKTIARKHGLHATFMPKPLFGVNGSGMHCNLSLFRNGANAFFDKDADLQLSETAKQFIAGIVKHATSFTAVTNPTVNSYKRLVPGYEAPCYVAWSAQNRSPLIRIPASRGISTRVEVRSVDPSANPYLALSVLLAAGLDGIKNKLEAPAPIDRNIYVMTKEERLENGIVDLPATLADALEEFKSNEVMVKALGDHLFEHFVEAKEIEWDMFRTQVHPWEREQYMSQY

SEQ ID NO: 6091 - protein, 47 aa, Bacillus licheniformis
MLLWGALIYELSKSSKKQNNRKIVSLISLGSLSTLVITISLFQNLPF

SEQ ID NO: 6092 - protein, 155 aa, Bacillus licheniformis
MNLSRFLNSIQLSPQSKPMMELLELNEKTKEHGLILTPSDIKMLIVYRNKVLHDHGRIELGIEVLKELIEVFAASPYMDEDNYVETLIELQEIFYYLRNETEDKIGDMKLIHQMMECFNGPSAGSLEILRSKMEELAESFRRDTMRSESLYKGDE

SEQ ID NO: 6093 - protein, 231 aa, Bacillus licheniformis
MDKENTLNRYDLVSNFTIDKSKLKQSQYMLSLLKEGQSVGVITSEKAYKIQVEIMQILQRLIGQYTKGESMSVTTETAEGIMVSLMYAIDAYALHFEKPEEFIVHLHSDSIKNIYTKGVALLHCYFEEAKQLYQDVKKIKLDVPVDAYTLTIDESLPVFMNHYNVIFEAQNTMASIDYPLAIDNMELQGVFYIKQYLERLLIETRFCHFFNHHDLMYVLANFGRICHFIIA

SEQ ID NO: 6094 - protein, 208 aa, Bacillus licheniformis
MLSDCHADKRANLINNAFDRLQRDLKTDQTISDYINLYRNEFIQRVNNAAEIDGFKMLIIREIEEREKPIALMLNENDRMSDIELRKLVDCIMERKNTAEKILLIRDHFVSLHDYLDLLNSGCLFDDEYDALFATFGNFELAIFAKIVFYEELRGGILNFIDIVADCSEAKSEWETYYMKFIKQLEDERIATIGHLINDIDYEEISFY

SEQ ID NO: 6095 - protein, 105 aa, Bacillus licheniformis
MFIKYNEYDLLELFESEPVSIADDPEAGELIYTFKDNQNFKLILTLDVYQLTCSLDITYKDFLVFTGVFQNITSIKKVEDFMVISIGEEKRIKVKFTKQIGVELL

SEQ ID NO: 6096 - protein, 142 aa, Bacillus licheniformis
MNSEIDKCIFCEIVSRKISSFEVYKTDYVTAFLDINPVTNGHTLIIPNKHIERLDHINDPHLSNEIMDSLIKVPQLLIQSGICDDYTILSDNGHFAQQDIKHLHFHVIPRHMNEKFEFKLNTDFTAAKKSNLLSIWKKIVGR

SEQ ID NO: 6097 - protein, 100 aa, Bacillus licheniformis
MNFDPEKLRKFLNCASNPSSPKNTKIKNYCVNQECQEFVAFDIDFENVDIALRIAGMLGKSATKFTINHFLFPGTNKIDYIQFIIFEINDSELLAFLEQL

SEQ ID NO: 6098 - protein, 325 aa, Bacillus licheniformis
MFFAKIIDRLALYDLHRKRSKDEHFSAFSLNPIDRDEFYKAKAADVAIMLYESRKNHLAGHFSYESLIPSGDPVNDALKGEVFLNKNDIDQPNVIFVHGWRMDSYDRIKKIFHDRIMNELGWNLYYYSLPYHFEREPEHSLYSGELMISANLNRTVDSTRQAIVDLRALIHWIKANKNGPVIIVGVSLGGWMTNLLATLETQIDIVVSIFYANRLSYAIWNTIPGKFIREELEQHGVTYEDLKTYWEITDPSQAAPKINKDNILLISAVHDQYVHLEDADKLWESWGKPERHLYNCGHAGIVLCRKKLALDTISFIRKKLKQLHK

SEQ ID NO: 6099 - protein, 159 aa, Bacillus licheniformis
MFRSKHNIPKVKFDYKFTSDESDIPMKMRKGPSVAMRVEGELEIKINEITYFKENIALLEFYVSLNEWIKKNKKKNKVTEYRYYTMEYEKGEPIISLIPFDYKARLTTIWETQQLYNVFDLDYITEQMEISRKKLGRDIEHHYRISLKSFVGKIPLRKY

SEQ ID NO: 6100 - protein, 198 aa, Bacillus licheniformis
MNFWHKRFQDENYVYGTEPNAFLADSQKKLQLSGDALAIAEGEGRNAVFLAEQGMNVTSWDYAESGLKKTQKLAETRHVSVKTELVDLNEASWNQDQWDEIVCIFGHFPEELRRKTLLGVKKAVKPGGFFVTEVYSTHQIPYKSGGPQDPELLYTPEEFLQIFSDWRTVHFFMGEVVRHEGDSHNGLSHVIQFIGQKQ

SEQ ID NO: 6101 - protein, 165 aa, Bacillus licheniformis
MKAGETMKNNIRLKRLLMISAILLLIVGGYVSAMIFGKKVVYEGTGESGLWHASIEKSDKTSIGPNYFLNLYWNGTEEDAKRTIVKTITLYIDGKKYDDRGEYDLSEYTGEEMDGGGHMEDHIATFDFMPEEDVIGHALSVKVEWKTGDEENAETMKLNKIPWYK

SEQ ID NO: 6102 - protein, 191 aa, Bacillus licheniformis
MNDIEIRRPRIDDVEELNQFFRIVVEDTFAKEGIADLLDDKESEIESKRQYLKADLDSKGNSRHFFIASDQRLNKIIGTIEYGPASELISICTDGALKDLYEVGTVFVHPDYQRRGIGTLLLNVMFLTFLNQGVNEFCLDSGYPGAQRIWKKKFGEPDYVLKDYWGKGYDHMIWRRRTKDMPIDTRTSVMP

SEQ ID NO: 6103 - protein, 158 aa, Bacillus licheniformis
MFNEREALRLRLEQLGDAEIQVMRELRKEREGIYSKLRELDRESEPAINKKSSLIDLASAAAEELKQSQHAADKHPPIKTPSHTIFQSKTTIQREAAINILSRYEEGLKGIKLKTEIEKETGFPIKNMTTFMKSLMKHRPDIKKPARGHYILHKEKDL

SEQ ID NO: 6104 - protein, 77 aa, Bacillus licheniformis
MKPNSTYIVYLAKTNARVFYMLDKKKYFMIMVPALILGFLFQFFVPSEQRYLGIVFILAGGVIYYLWVHIEKDKQKD

SEQ ID NO: 6105 - protein, 206 aa, Bacillus licheniformis
MELTITRALSELKMLDKRIKRAVNEATFGGLMIGKKLPNGFRTTEDLESRAKADYQSIEALIKRRNAIKSAIVVSNATTKIEVAGVKMTVAEAIERKTSISYDIQLLDKLKEVYADLVGEAENVNQKVTERLDKHLETLFGKDGKVKAAENQEIVKSFLAENEAKIIDPLNLKEKIDCLSKKIEDFEMEVDFALSESNTLTKITID

SEQ ID NO: 6106 - protein, 194 aa, Bacillus licheniformis
MSKQTSGKYEKILQAAIEVISEKGLDKASISDIVKKAGTAQGTFYLYFSSKNALIPAIAENLLTHSLDHIKSKVDGTMSFWTALDIMIDETFNMTELHQDIIVLCYSGLAFDHSMEKWEAIYQPYYSWLEGLIEKAVEKNEVIPAINVRWTARTIINFVENTAERYYIGAENDEELSVFKKEIFTFLKRSIGTK

SEQ ID NO: 6107 - protein, 111 aa, Bacillus licheniformis
MSWLLVIAAGFLEVVWASGLKHADSFVDWLMIFVLIAVSFIMLIRSYRNIPMASAYTVFVGIGTAGTYVTGIFMGETFSGGQIFFLIVLLGGIIGMKMFTKENNAQSGGDE

SEQ ID NO: 6108 - protein, 105 aa, Bacillus licheniformis
MPWMFLVISGIEEVIAAIAMKYVDGTRKKWPIIVMVLGFGLSFFCLSKAMQMLSAGVAYAVWTGIGSIGITAVSLFWFKERIRAPQLISLGFIIIGVIGLRLTSS

SEQ ID NO: 6109 - protein, 180 aa, Bacillus licheniformis
MINQLKLRPLEREDLPFVHRLNNDAKIMSYWFEEPYETFVELQDLFDKHIHDQSERRFIIEKETEMIGLVELVEIDYIHRRAEFQIIIDPEHQGNGYSSSATYLAMNYAFSVLNLHKLYLIVDEDNAKAIHLYKKAGFTIESELQDEFFVDGYYRNAIRMCIFQDEFLSLKKSKEEGMQG

SEQ ID NO: 6110 - protein, 118 aa, Bacillus licheniformis
MKNHIPWISLMIIFAAFLSGCNLNRVGTDEYYVHITGNGEEDTSKFDDGEEYSVFKYELAGFDEDGQEKTMEFTADKNLRIGAFLRLFYSENKGVKSWEEVDKDDIPAKAKEQLGVKN

SEQ ID NO: 6111 - protein, 144 aa, Bacillus licheniformis
MKKIVCLMVFSIMTAFGIHIQPAEAAVIKDEKKMTMTMTEDHVGFFMADSTNVNYYPTWLYYKLTIFNAEGCTLNIKLQRITLTGHAVTLSEKEYTGNHLHLSAADKVSGSPHRNHFLDITKVSGCGDVGITGFYGFEHQMPGY

SEQ ID NO: 6112 - protein, 48 aa, Bacillus licheniformis
MLLCSAAGYALYQHVAGGRNEQAGAVLHQQALHFKLSTLEGGDIELKK

SEQ ID NO: 6113 - protein, 287 aa, Bacillus licheniformis
MFFHIKELQYHAKPDKPDPLFAKKLQEILGGQFGEISVALQYLFQGWSVRGNGKYKDLLMDTGAEELAHIEMLATMIARLLDGAPVGDLEKAAKDPVIGAILGGMNPQHAIVSGLGAMPADSVGNRWTADYIIASGNLLADFRANLNAESQGRLQAVRLYEETTDRGVKDMLSWLIARDTMHQNQWLAAIKELEAKENVVVPSTFPRNLEKREVSHVLFNFSRGNESAAGRWAKGPSMDGEGVFQYVEHPQPLAKKPVLRPAPPYIHDTPPSVIQHHRDDVLPPNLY

SEQ ID NO: 6114 - protein, 266 aa, Bacillus licheniformis
MKTYKETAVFEHTFWLQVLGDHARFILDSLAEREKNDIQKAKQFKQAFDVLLKKVNASPDLYSLTLEAEEYALQFRKFKLFIIKRHLTGDIKIHLSPTFINHMVNELEEHLLVLKYLKKREAPPVFHELHHHMLWLMDAAGHAGAIADDLDAVEKRLKEKSREFVKHFEQFYIKSVELTGYLRANVESFPALRRMNKDVKLEIELFRTFLKEVEELELTDQMLGTFSALMADHMMREECYYLMKIAESTNTQEPACDPAKPRLLEK

SEQ ID NO: 6115 - protein, 172 aa, Bacillus licheniformis
MQVRKIKDSDAKSYLKLCETIDEESEFMLFEPGERKLHAQRQIKQIESGMCEVFVCAADDGSLIGYVAAAKGQVQRARHRAHVVIGIRQAYIGQGIGVKLFQALEKWACEEKIHRLELTVMTHNTAAVRLYKKTGFIIEGTKKHALKVKGQYVDEYVMSKLINEQQREVSNE

SEQ ID NO: 6116 - protein, 100 aa, Bacillus licheniformis
MNDGCHQAIAAVSYYKTERTIDFNRQTYTKKQNQMYLYNDKILTASRQYRLEHVYDVSYRPFSEAGLLYLHTNKGVFAYEVNVDPGYFIEAFKKQKNPIK

SEQ ID NO: 6117 - protein, 192 aa, Bacillus licheniformis
MKKKTQNTVQKIVEAGYRLFAQNGYSATSVDEIMKEAGFSKATFYLYFKSKEMLFLHIMNEQMEDRFQTSMNCFRKKTLRGLLAGIEHLIQTSNKEHSTALFLEFMANSHRYPEIQRKVALLYEQWREFFVEMIEQLQEEGIVQKQLHPKVMASTLIAIFNGYNHQHHADPSINKQEQLQSIIFLLNPKLHL

SEQ ID NO: 6118 - protein, 151 aa, Bacillus licheniformis
MGSQDMERYEEELSLKAFIVLSRALQSIKKRVEEDIKCLGLNPTEFAVLELIYNKGDQPIQKIGEKVLIASSSITYVIDKLEKKSLIVRRPCPKDRRITYAALTNEGTALMNNLFPKHKAAMKGIFGGLDIKEKEVLIEKLKKLGFHAQSM

SEQ ID NO: 6119 - protein, 207 aa, Bacillus licheniformis
MTEFLELVKERRSASNFLPGYSISEQELNEIFEIVKLAPSAFNLQHTNYIAVLDKEKKNMLHEAANGQYKILSSSAVIIVLGDKKAFHQAKEIYEGLKLLGVLNKQEYDDMVHDTVSFYQSRGEAFQRDEAIRNGSLSSMLFMMAAKEKGWDTCPMIGFDPQKVKEVLNINEQYEVVMMITLGKEKLESRKPRGFRKPVNEFVTYIS

SEQ ID NO: 6120 - protein, 312 aa, Bacillus licheniformis
MKKKTSGIHHITAIVGHPQENVDFYAGVLGLRLVKKTVNFDDPGTYHLYFGNEGGKPGTIITFFPWVGARRGVIGDGQVGVTSYVVPKGAMAFWENRLAKFNLPYTKMNRFGEEYLEFDDPHGLHLEIVEREEGEKNSWKIGEITPDKAIKGFGGATLLSKQPEKTAELLEKVMGLEKVGEEGDFVRFRSSGDIGNIIDLKLTTIGSGQMGIGTVHHIAWRAIDDNDQLEWQKYVAENGYRVTPVQDRNYFNAIYFREHGEILFEIATDPPGFAHDESHQTMGEQLMLPAQYEHYREQLERRLIPITVKALD

SEQ ID NO: 6121 - protein, 202 aa, Bacillus licheniformis
MLSIDPLTKTERENYKFLIGSIIPRPVAFVTSLSEEGVLNGAPFSYFNIVSSNPPMISLSIQRSEGSQKDTARNILKSKEFVVHIVDEQNVEKVNATAASLPPSQSEIQLAELTPVESVKVSVPGVKEAKVRMECVLEYSLELGDKHSPGCDFMIGQVVQYHIESGIYENGKIDPRGLGAISRLAGHDYAKIGEIFTRERPK

SEQ ID NO: 6122 - protein, 203 aa, Bacillus licheniformis
MSNVKLAVVFYSMGGTNYQLAKWAAEGAKEAGADVKVLKVQELAPQSVIEGNEVWKATVDATKDIPVVTSEDIEWADAIIFSTPTRFGNMASQMKQFLDTQGGLWANGKTVNKVVSAMSSAQNPHGGQEATILSLYTSMMHWGAIIASPGYTDPVLFGAGGNPYGTSVTVDQDGKMIEDVEAAVKHQAKRTVTVAEWVKKGNQ

SEQ ID NO: 6123 - protein, 277 aa, Bacillus licheniformis
MNEKQPKKNKNKTLLGGIIVAAALIIGGFTASLFIEKIPNGYVGVVYSPNGGVKSETLDQGWHLVGLFDKVTRYPVRMQTVNNQDIQVATSDGKNISMDIAYNYVVQPDKVVELFNKFGAVDIESIENSYLKTRLWDAARKSISKYSVIDTYGQKSSDAAAEIQKTFADDMKGLGFVIDDLTLGVPKPDKATQEAIDARVKSSQELERTQTELKIAEAEAKKKKIEAQGIAEYNEIIKKSMSDEMIKYQWIQKWDGKMPKATGSNSLIQIPTDEKGK

SEQ ID NO: 6124 - protein, 252 aa, Bacillus licheniformis
MFAPEAILRTWRKFDSFPMETLTKAWFYHQAGDGRQREVSMMKEHYQEYGIAGNCFDLSIWLLDEFTKDGVEAFPIGRSFKTERAHAAVIALDERGRRFLCDLGDQWLHPILIDCESEDYTNEKLGGFFPAAQVQVMPTAGGVEVLYHRPNGKVSTQVYNTDPVDMSVFLKAAEYSQAALKPAPLLECRIPFQHEIAHWEFSGWDIYLSTSKGLYREAKPDTIEGWTEKIHDISGYDKNVLKKALEIYQTRA

SEQ ID NO: 6125 - protein, 279 aa, Bacillus licheniformis
MSHYDQQYNAIIQKIIESGISDEEYQVRTKWDSDGTPAHTLSIMSEKMRFDNSEVPILTTKKVAWKTAIKELLWIWQLKSNDVQVLNDMGVHIWDQWRLEDGTIGAAYGYQLGKKNRTVNGQKVDQVDYLLHQLKHNPSSRRHLTMLWNPDDLDGMALTPCVYETQWYVKEGKLSLEVRARSNDMALGNPFNVFQYNVLQRMIAQVLGYELGEYIFNIGDCHIYTRHIDNLNIQMKREQYEAPKLWINPDIKNFYDFTIDDFKLIDYKHGDKLTFEVAV

SEQ ID NO: 6126 - protein, 142 aa, Bacillus licheniformis
MIKKWAVHLLFSALVLLGLSGGAAYSPQHAEGAARYDDILYFPASRYPETGAHISDAIKAGHSDVCTIERSGADKRRQESLKGIPTKPGFDRDEWPMAMCEEGGKGASVRYVSSSDNRGAGSWVGNRLSGFADGTRILFIVQ

SEQ ID NO: 6127 - protein, 207 aa, Bacillus licheniformis
MTKLSKRQLDILRFIKEEVKRKGYPPSVREIGEAVGLASSSTVHGHLARLETKGLIRRDPTKPRAIEILDTEEEIHIPKNQVVNVPVIGKVTAGTPITAVENIEEYFPLPERLAPPDEHVFMLEIMGESMIDAGILDQDYVIVKQQNTANNGDIVVAMTEDDEATVKRFFKEETHIRLQPENPTMEPIILQNVTILGKVIGVFRTVH

SEQ ID NO: 6128 - protein, 103 aa, Bacillus licheniformis
MKKESLIFVSLFTAVISCCILFVSFAGKIEERKQYVKIEVQEGDTLWELADRIKGGKTADKHKFIEWVADKNNLPTSVIKPGDVLILPVAKQHSDQYQLAVVE

SEQ ID NO: 6129 - protein, 215 aa, Bacillus licheniformis
MNAIIYTRVSTAKEQQETSLKRQEEELKSLAAEHGMNVVSVISEQASGYEMDRDGVFDLLEEIKTSDIDAVLIQDDTRLGRGNAKIALLHCLYKEGVQIYTLAHRGKLELSEADSMVLEIVGIVEEYQRKIHNLKIKRGMKKAVENGYRPERNLKHRNEGGGRERIEAPLSEIVRLRENKLTFAEIAAVLRGFGYSISKATVHRRYQEYKDGLAD

SEQ ID NO: 6130 - protein, 77 aa, Bacillus licheniformis
MISKEKIARINELAKKAKSGSLTDEEKAEQQKLRQEYLQGVRASMKNTLKTVTIVDPEGNDVTPEKLKQEKRNRRLH

SEQ ID NO: 6131 - protein, 667 aa, Bacillus licheniformis
MKTIELKSVATIRTLSIDAIEKAKSGHPGMPMGTAPMAYALWTKMMNVSPENPNWFNRDRFVLSAGHGSMLLYSMLHLSGYDVSIEDLKNFRQWGSKTPGHPEFGHTPGVDATTGPLGQGIGMAVGMALAERHLAETYNRDDYRVVDHYTYSICGDGDLMEGISSEAASLAGHLNLGRLIVLYDSNDISLDGELNRSFSENVKQRFEAMNWEVLYVEDGNNIAEITAAIEKAKQNEKQPTLIEVKTTIGFGSPNRAGTSGVHGAPLGSEEAKLTKEAYEWTYEEDFYVPSEVYEHFNETVKEAGKKKEAEWNELFSAYKKAHPELAEELELAIKGELPEGWDQKVPVYEKGSSLASRASSGEVLNGIAQQVPFFFGGSADLAGSNKTTIKNGGDVSAKDYAGRNIWFGVREFAMGAALNGMALHGGLRVFGGTFFVFSDYLRPAIRLAALMGLPVTYVFTHDSIAVGEDGPTHEPIEQLASLRALPNLSVIRPADGNETAAAWKLALQSKDQPTALVLTRQNLPTIDQSAETAYEGVKKGAYVVSKSQNEKPEAILLASGSEVGLALDAQSELQKEGIDVSVVSVPSWDRFDKQPAEYKNAVLPTDVTKRLAIEMGSPLGWERYTGTDGDILGIDQFGASAPGETIMKEYGFTPANVVDRVKKLLNR

SEQ ID NO: 6132 - protein, 145 aa, Bacillus licheniformis
MERHYYTYLIEEEFASHYFGRESVMFKLFYDYHWTSPDQKSQLAAKQIEFITKPIPAAHIHKRMKMNLCREDYTQVDYVYRLIVPKGSASFIIKDRHIEILAKGPFDAETVFFEVLRKVSPCFLAMDFNMKRYGWLNPVKERNFV

SEQ ID NO: 6133 - protein, 72 aa, Bacillus licheniformis
MDLWVVILVGVLALLAGVALGFFIARKYMMNYLKKNPPINEQMLRMMMMQMGMKPSQKKINQMMKAMENQTK

SEQ ID NO: 6134 - protein, 53 aa, Bacillus licheniformis
MKENLLHEIEEKRKELLKIVMTNGMTSHITIQHSQQLDILLLEYQKLSLGNTQ

SEQ ID NO: 6135 - protein, 235 aa, Bacillus licheniformis
MADINYILAFGAGFLSFISPCCLPLYPAFLSYITGVSMSEIHSDKLMFQKRSLVHTVFFLIGFSMIFVALGYSTSLVGSFFKDYHQLIRQLGAVFIIFFGFVTLGVFKPEFLMKERRLQFKNRPGGLLGSIGIGMAFAAGWTPCTGPILAAVIALAGTNPMSAVPYMALYALGFSLPFLLLSFFITKMKWLRKHQLIIMKIGGVAMIVVGILLFFDWMTKIIIVLSSLFGDFRGF

SEQ ID NO: 6136 - protein, 123 aa, Bacillus licheniformis
MTRVLIVDDAKFMRDKIREILETEDLQVAGEAENGEEAVLLYQELQPDLVIMDITMPVKNGIEALKDMIQLNPKVKVIMCTAMRQKRIVVEAIEAGAKDFIVKPFEETKVVEAIRHVLGNACS

SEQ ID NO: 6137 - protein, 161 aa, Bacillus licheniformis
MMIVVSSILAIVMAVIVMAVRIKSSEKPATAKKIILPPIFMSTGALMFLFPVFHVTGAEFLEALTVGMIFSIFLIKTSKFEIRDDKIYIKRSKSFVFILIALLVIRIVMKSILSTTIDYGALSGMFWILAFGMIVPWRIAMYLSFRKLSSQIEASNHIQVN

SEQ ID NO: 6138 - protein, 142 aa, Bacillus licheniformis
MLEGWFLWLMLAWIVIMIVLLSIGGFFMFRKFLKRLPKEDGKSELDWQDYYIEQTRHLWNDEEKELLEELVSPVPELFRDVAKAKIAGKIGELALKEKAGAIDRDLIIRGYIMATPKRDHKFLVKRLKEKNIDHSTYQELFK

SEQ ID NO: 6139 - protein, 135 aa, Bacillus licheniformis
MTNTKRFDSADFDKEWMKQFVDDPFLLYDETLPIDLYETSTEYIIEADLSHLNVRHLDLTFSGYDFKLAVKTDEQLYEKSLMLPFFLNDKQIEAECENNILAVKINKESSKDDISLSINIPFISNLHNKQNPDSA

SEQ ID NO: 6140 - protein, 48 aa, Bacillus licheniformis
MTNKNDGKDMRKNAPKGAQPGQPEPLSGSKKVKNRNHTRQKHNSSHDM

SEQ ID NO: 6141 - protein, 48 aa, Bacillus licheniformis
MAKRKANHVINGMNNAKRQGNGAGYIENDQHILTEAERQNNKKRKTNQ

SEQ ID NO: 6142 - protein, 908 aa, Bacillus licheniformis
MANQQQIAKKDAFQSRKTFTVQGKTYSYYSLKALEDQGIGNVSKLPYSIKVLLESVLRQVDGRVITEEHVENLAKWGTAELKDIDVPFQPSRVILQDFTGVPAVVDLASLRKAMASVGGDPDKINPEIPVDLVIDHSVQVDKAGTEDALTVNMDLEFQRNAERYKFLSWAKKAFNNYQAVPPATGIVHQVNLEYLANVVHAVEEDGEIVTYPDTLVGTDSHTTMINGIGVLGWGVGGIEAEAGMLGQPSYFPVPEVIGAKLVGKLPNGTTATDLALKVTQVLREKGVVGKFVEFFGPGVAELPLADRATIANMAPEYGATCGFFPVDEEALEYMRLTGRDEEHINVVKEYCRQNGLFYTPDQEDPVFTDIVEIDLSKVEANLSGPKRPQDLIPLTDMKETFHKHLASPAGNQGFGLNASEADKEIKFKLENGEEAVMKTGAIAIAAITSCTNTSNPYVLIGAGLVAKKAVELGLKVPNYVKTSLAPGSKVVTGYLVNSGLLPYMRELGFNIVGYGCTTCIGNSGPLAPEIEKAVAENDLLITSVLSGNRNFEGRIHPLVKGNYLASPPLVVAYALAGTVDIDLKNEPIGVGKDGQNVYFNDIWPTMDEINSVVKQTVTPELFRKEYERVFDDNERWNAIETTDEALYKWDEESTYIQNPPFFENMSVEPGTVEPLKGLRIVGKFGDSVTTDHISPAGAIGKDTPAGKYLQEKGVSPRDFNSYGSRRGNHEVMMRGTFANIRIKNQIAPGTEGGYTTYWPTGEVMSIYDACMKYKEDGTGLVVIAGKDYGMGSSRDWAAKGTNLLGIKTVIAESFERIHRSNLVLMGVLPLQFKEGENAETLGLTGKETIEVDVSESVRPRDLVQVKAIAEDGTVKSFEAVVRFDSEVEIDYYRHGGILQMVLRNKMKQ

SEQ ID NO: 6143 - protein, 167 aa, Bacillus licheniformis
MKKVLAAAFLLVLAGLAVWNFTGQKEAEIGIEKGDKAPDFTLPSLKNGNDVSLSDFKGKKVLLNFWATWCRPCETEMPAMEELQNENQDIAVLAVNFTSSEKNEKTVKAFAERHGLHFPIVLDRTGINAKYEIFSYPTTFIIDENGIIKDIVLGTMSKKNMEEKLGL

SEQ ID NO: 6144 - protein, 41 aa, Bacillus licheniformis
MKKAKRRTFEELVSENKKELMTNQEFLDRLEDKLEEKFKLK

SEQ ID NO: 6145 - protein, 47 aa, Bacillus licheniformis
MPREHDKQSKFAPSHLGTKPVEYKRNKGKKMHDKSGETPIIMQTKGE

SEQ ID NO: 6146 - protein, 78 aa, Bacillus licheniformis
MTHQKHHPDDRSDNVEKLQDMVQNTIENIEESEEQLSFASEAEQEQIREKNERRNESIEAMRNEIHDEAEARKNGYHQ

SEQ ID NO: 6147 - protein, 138 aa, Bacillus licheniformis
MYVSKKEIEVRYAETDQMGVVYHANYLIWMEVGRTALIKELGFSYAEMEKDGILSPVVDINVRYVKPLRYGETATVHTWIEDYNGFKTVYGYEIFNSAGETAVKGTSSHICVDGDSFKPVQFRKLYPKWHEAYEEAKK

SEQ ID NO: 6148 - protein, 100 aa, Bacillus licheniformis
MAFGIKRNELNEWKRAVLNGEVAFLTHYWLDDRYPDVKTVTKAGCANIEKLAEWGKQYGLKKEWIDKRSEFPHFDLLGEKQIMILKQEKLSSHIKRFRLE

SEQ ID NO: 6149 - protein, 119 aa, Bacillus licheniformis
MKWFLGILTAGLIILVGGYFLYSGYYSTEDYYVKITTDPKVVKEKASDGYTYINYNYDVTGYDKDGKSKNLKLSSQEKMQKGQYYIIHWEDRREIISSKEKASEKQIDKDILHKLDNQN

SEQ ID NO: 6150 - protein, 343 aa, Bacillus licheniformis
MVYGVTTFILLAVFLIFYLTDRRRIINGFLFNLFFCSFLVLSYYLAYVFGIGFFRLFVIVPLLIFFFILTFGLFALMIGLFLNARILIKREGRRLSNCLTLISGLGIIIFFLLSVIDPARFLSPNVQPLFAGSSLIAVYFFFHLTNFLTAYFLYQFNRPKLNQDYIIVLGSGLINDTVPPLLASRIDKAVDFYRKQAAVAPPPKIIFSGGQGPDENLSEAEAMQRYALKKGIPEEHTFKEDRSVNTYQNMLFSKQLMDSLSDGKYNSIFTTNNFHLFRASLYAKRAGLKSQGIGSKTAFYYWPNAMIREYIAVVVMNRKRHSIVVGTILGFSIILTALNFFID

SEQ ID NO: 6151 - protein, 95 aa, Bacillus licheniformis
MNLKINEEALKWYKNELDLKEGDQVRFFVRYGGCSNVQKGFSLGVSKDEPQQIGVSAEKDGITFFVEESDVWYFDGHDLLVTYNESAEEPVFEYQ

SEQ ID NO: 6152 - protein, 197 aa, Bacillus licheniformis
MLIALLFILAYLLGSIPSGLIVGKAAKGIDIREHGSGNLGATNAFRTLGVKAGSIVVAADILKGTLAAFLPAILHIGVHPLLAGVAAVIGHMFPVFAKFKGGKAVATSGGVLLCYQPLLFLTMVAVFFLFLYITKYVSLSSILTGLYTTVYSLFTKDLLLVAVVAFLTAFVVYRHRTNIKRIIDKTEPKIKWMSGKR

SEQ ID NO: 6153 - protein, 137 aa, Bacillus licheniformis
MENPSKQEIKTILENSRRIAVVGLSDNPERTSYMVSKAMQDAGYDIIPVNPTIDEALGVKAVASLKDIEGHVDIVNVFRRSEHLPDVAKEFLEIDADVFWAQQGLVNEEAYQLLSEKGYTVIMDLCIKVAHSLTKSA

SEQ ID NO: 6154 - protein, 655 aa, Bacillus licheniformis
MVKKQQVDYNDDSIQVLEGLEAVRKRPGMYIGSTDSRGLHHLVYEIVDNSVDEVLAGHGDHIIVKIHKDNSISVQDRGRGMPTGMHKLGKPTPEIILTVLHAGGKFGQGGYKTSGGLHGVGASVVNALSEWLTVTIERDGNVYRQRFENGGKPVTSLDKIGTTKKTGTLIHFKPDPAMFSTTTFNFETLSERLRESAFLLKGLKIELIDERDQTKETFLYENGIEAFVAYLNEEKDALSEVVSFEGEHNGIEVDFAFQFNDGYSENILSFVNNVRTKDGGTHESGAKTAMTRAFNEYARKVALLKEKDKNLEGTDIREGLSAIVSVRIPEELLQFEGQTKGKLGTSEARSAVDAIVSEQLAYFLEENRETATLLVKKAIKASQAREAARKAREEARSGKKRKKSEATLSGKLTPAQSRNPSKNELYLVEGDSAGGSAKQGRDRKFQAVLPLRGKVINTEKAKLADIFKNEEINTIIHAIGGGVGADFDIEDINYDKVIIMTDADTDGAHIQVLLLTFFYRYMKPLIEHGKVFIALPPLYKVSKGSGKKEIIEYAWSDEEMDDVLKKVGKGYTIQRYKGLGEMNADQLWETTMNPESRTLVRVKIDDAARVERRVTTLMGDKVEPRRKWIEKNVAFGLDEESNILENENLSVAEEV

SEQ ID NO: 6155 - protein, 807 aa, Bacillus licheniformis
MAQPEIYHDLPLEDVIGDRFGRYSKYIIQDRALPDARDGLKPVQRRILYAMHAEGNTYDKNFRKAAKTVGNVIGNYHPHGDSSVYEAMVRMSQDWKVRNVLIEMHGNNGSIDGDPPAAMRYTEARLAAIASELLRDIDKETVEFVPNFDDTSKEPVVLPAMFPNLLVNGSTGISAGYATDIPPHHLGEVIDAVIKRIDSPNCSVDDLMEFVKGPDFPTGGIIQGKEGIKKAYETGKGKIIIRGKAEIETIRGGRQQIVITEIPFEVNKANLVKKMDEFRIERKVEGISEVRDETDRTGLRIVIELKKEADAQGILNFLYKNTDLQIPYNFNMVAIHNRRPMLMNLTSILDAYIGHQKEVITNRSQYELKKAKERHHIVEGLMKALSILDEVIATIRSSNDKRDAKNNLIEKFAFTEPQAEAIVSLQLYRLTNTDITALQEEAKELDQKIKELEEILSNDKKLLKVIKDSLKKVKKTYASQRRSVIEEKIEEIKINLEVMVASEDVYVTVTKDGYIKRTSQRSFAASNGQDFGMKDTDRLLCQLEMNTTDVLLLFTNKGSYVYCPVHQLPDIRWKDLGQHITNIISIDSDESIVKAIPVREFTESEYLLFFTKNGMAKRTQLMQYKAQRYSKALVALNLKGDDEVVDVHVTDGTKDLFIATHSGYGLWFTEDEVSVVGARAAGVKGVNLKDGDFVASGQVLEEKDVLVLVTQRGSIKRMNRSEFEKTSRAKRGVLMLRELKKKPHRIAGLLACSYHDQITLQTEKGITEEMLVKEIKLHDRYSNGSFIIDEDEAGEVTDVWISKHELE

SEQ ID NO: 6156 - protein, 363 aa, Bacillus licheniformis
MKPKYKVIINDIKSKILSGVYRAGDQIPTESAIQEEYKVSRHTVRKAILELSNEGFLRSEKGSGTYVSNQYQSKAGGNSNNKIIGVITTYISDYIFPSIIRGIEGRLNEANYSLLLASTNNDVEQEKKALEMMLSFGVDGLIVEPTKSNLYNPNIAYYLSFKEQDIPFIMINAYYEELDVPFLCLDDVQSSYLATKELISKGHTQIGLISKMDDLQGKYRMKGYIKALGEAKLRFYPEHVLSYNIETKLDLYTDLKKFLNEKRDVLTAIVCYNDEVGLEVANVCRQLNISIPDKLSIIGQDNSYIAKNANIKLTTLTHPQEQMGHDAADWVIKKLQGKKDLPNETYYQPVLVEGETVKELEIQ

SEQ ID NO: 6157 - protein, 535 aa, Bacillus licheniformis
MKANRVNIKQAITEGETSLGIEFGSTRIKAVLIDSSFETIASGSYEWENLLEDGFWTYNLVDIITGLRTAYSEMKNEVERNYGITIRKIGSIGISAMMHGYMAFDKTGELLVPFRTWRNSTTGAAAKELTDQFQFNIPERWSIAHLYQAILNEEKHLPRIDYITTLAGYIHWLLTGNKAIGIGDASGMFPIDESTQNYNESMVKQFDELISNKGYPWKLKDILPKVYISGEQAGELTEIGAKILDQSKNLQPGIPICPPEGDAGTGMVATNSVRKRTGNISVGTSVFAMIVLEKELSKVYPEIDLVTTPNGSPVGMVHANNCSSDINAWLGLFREFFEAMGQKIETNKLFEVMLNKALEADSDGGGLLSYGYFSGENITGLEKGRPLFVRSPESRFNLANFMRTHLFTAFAALKIGMDILTKEEKIEIDSILAHGGLFKTPLVGQKIVAAAMNTPVSVMETAGEGGAWGMAILASYMMNKGQEESLEDFLDKKVFEEDAGQEIYPDQLDVEGFEAFIERYKKGLMIEQAAVDHLI

SEQ ID NO: 6158 - protein, 231 aa, Bacillus licheniformis
MLEQLKEEVLQANLDLPKYGLVKYTWGNASAIDRETGLFVIKPSGVDYETMKASDMVVVDLDGNVVEGELRPSSDTATHAVLYKRYPEIGGIVHTHSTWATIWAQAGLDVPAMGTTHADTFYGSVPCARYLTQEEIDRGYEAETGHVIIETFEERGLDILAVPGVLLHGHGPFTWGKDVKSAVLNSVVLEEVAKMNLFTRELNLFAKELPQRILDKHYLRKHGKNAYYGQK

SEQ ID NO: 6159 - protein, 474 aa, Bacillus licheniformis
MLTTGKKEFWFVVGSQHLYGEETLAEVRAHAQAMTDALNESAVLPYPLVLQDLAVNADKITSIMKEVNYRDEVAGVITWMHTFSPAKMWIRGTKLLQKPLLHLATQFNESIPWPTIDMDFMNLNQSAHGDREYGFINARLKKQNKVVVGYWERPEVQQQIAEWMDVAVAYNESFNIKVARFGDNMRNVAVTEGDKIEAQIQFGWTVDYFGIGDLVQYVNAVTDEEINRLFAEYADLYEFDYGTYSREDWEKSVKVQASYEIAIKRFLDDGGYNAFTTNFEDLYGMKQLPGLAVQRLMAQGYGFAGEGDWKTAALDRLLKVMSRNQSTGFMEDYTYELAAGQESILQSHMLEVDPSLASNKPKIIVSPLGIGDREDPARLVFDGKAGDGVVVSMADFGTHYKLLINEVSAFEPTVPAPNLPVARVLWEVKPNFQDGVKAWLENGGGHHTVVSLFLTTDQMITYAKLVDLEYVVIK

SEQ ID NO: 6160 - protein, 464 aa, Bacillus licheniformis
MVNEKKISSGFIYFFGAFAGILFGYDIGVMTGALPFLQNDWNLQDNAGVIGWITSSVMLGAIFGGALAGQLSDRLGRRKMILISAIIFVVGSILSGIAPHNGILFLIVSRVLLGLAVGAASALVPAYMSEMAPARLRGRLSGINQTMICSGMLLSYIVDFLLKDLPETMAWRLMLGLAAVPALILYVGMLKLPESPRFLIKNNKLDEARKVLSYIRSNKGEIDSEITQIQETAREEAKANQNASWATLLSNKYRFLLIAGVGVAAFQQFQGANAIFYYIPLIVEKATGNAASSALMWPIIQGVILVLGSLIFLVIADKFNRRTLLTVGGTIMGLSFILPAILNILIPNANPMMMVVFLSIYVALYSFTWAPLTWVIVGEIFPLVIRGRASGLASSFNWIGSFLVGLLFPVMTASMSQEAVFAIFGVICLLGVVFIRTRVPETRGRSLEEIGKNGENKRVDGKSA

SEQ ID NO: 6161 - protein, 260 aa, Bacillus licheniformis
MSKVSGKIAFVTGGGQGIGEAICKRLAEDGFAVAVADYNVETATQVAEDINKLNGKAIAVKVDVADRDDVFKAVDETVKRLGGLDVVINNAGLGPTTPIESITYEDYRKVYDVNVGGTYWGIQGGVKAFKELGHGGKIINASSQAGQVGNPGLAVYGGTKFAVRGITQTAAKDLAELGITVNAFCPGIVKTPMMMGIAQQTADEAGKPFEWGMEQFAKNIALKRLSEPEDVAACVSYLAGPDSDYMTGQALIIDGGMVFN

SEQ ID NO: 6162 - protein, 114 aa, Bacillus licheniformis
MKKTLFLQLSIFFLVIASLHSFSMPQMPANHHAQKAAVSGDELHELTVGKYGEEKAKSLWNSLGFGAESVLLLILAAASGQAFMMNRRKEHLKAFMLAVFYHSSYFDKAHVLKP

SEQ ID NO: 6163 - protein, 470 aa, Bacillus licheniformis
MEEILSEIINVPSGFIWTYLVYILIGIGLFFTFKLKFVQFRYFFEMFRIVGQKEEKGKGVSSLQAFFISAASRVGTGNLTGVALAVATGGPGAVFWMWVVALVGMASSFVESTLAQVYKVKDGDHFRGGPAYYMEKALGARWMGIIFAVLITITFGLIFNAVQANTIVGSMQGAFNLDKTVVGIILAAITGFIIFGGLKRVVTVSQLIVPVMAIIYLGLALFVVLTNISQIPAVFAMIVKDAFGIEQIAGGTLGSIIIIGAKRGLFSNEAGMGSAPNAAATANVSHPAKQGFIQTLGVFFDTMVICSATAFMILLFNLTPGKELDGIQITQAAMQHHIGSWAPAFVAVAIFLFAFSSIVGNYYYGETNIEFIKKSKTALAVYRTAVVAMVIFGSVSGFQLVWDMADLFMGLMAIINLIAILLLSGIAAKVLKDYTEQRKAGKNPVFKASSIPGLKNTEAWEDEKETLQSK

SEQ ID NO: 6164 - protein, 228 aa, Bacillus licheniformis
MIEQILWVILPYIVITIFIGGHIYRYQHDQFGWTAKSSEMLEKKKLALGSSLFHWGIFFVIGGHVMGILIPESLYEALGVSEHMYHKIAIGFGLPAGIAALSGLLILTYRRFTDKRIRKTSSAGDLITLVALLFVMTTGLAATFLNIDSKGFDYRTTIGPWFRNIFLFKPDAGLMASVPLWFKLHIIMGYVIFIVWPFTRLVHVFSMPLKYLTRSYVVYRKRAPRKSM

SEQ ID NO: 6165 - protein, 180 aa, Bacillus licheniformis
MDGTDKQTVFAALSYLLSYPDEEWRKERSEWQQIIGEIEHEALKGHLLAFLESAASYSSEELIETYVYTFDFGKKTNLYVTYFNSGEQRERGIELLQLKDLYQQSGFQPTDKELPDYLPLMLEFAAVADQEKAAAVFQKYAANLEELRSQLSENESIYTPLLDGLMLILEEIGVERNVQP

SEQ ID NO: 6166 - protein, 489 aa, Bacillus licheniformis
MKIKAQIGMVMNLDKCIGCHTCSVTCKNTWTNRSGAEYMYFNNVETKPGIGYPKQWENQDKYKGGWELKKGKLQLKSGAKATRLMNLFYNPYQPTIDDYYEPWNYDYETLTNSPEKKHQPVARPKSSITGDFMNLEWGPNWEDDLAGGHITGLQDPNVKKMEESIKTEFEDVFMMYLPRICEHCINPSCVSSCPSGAMYKREEDGIVLVDQNACRSWRHCVSSCPYKKVYFNWQTNKAEKCTLCFPRLEAGLPTICSETCVGRIRYLGVMLYDAEKVEEAASAENEKDLYHSQLEIFLDPNDPAVAEEAKAQGIPLEWIEAAQKSPIYKMIIDWKIALPLHPEYRTLPMVWYIPPLSPIMNMFEGKGTAQSAEDIFPAIDEMRIPIEYLANLLTAGDTHHIRTTLKKMSVMRMHMRATQTNKQIDSSLIQDTGLTEEQIEDMYRLLAIAKYDDRFVIPQTHREEVADLYMEQGSCGLSFAGGPGSCQNI

SEQ ID NO: 6167 - protein, 1228 aa, Bacillus licheniformis
MKKKKKSPIFRRLNYFSPIERHSNQHSQTTYEDRDWEDVYRNRWQHDKVVRSTHGVNCTGSCSWNIYVKNGIVTWEGQRLDYPSTGPDMPDFEPRGCPRGASFSWYIYSPLRVKYPYVRGVLIQMWREALNSSKNPLEAWKSIVENPEKAKAYKQARGKGGFVRAEWSEVLKLISASLLYTIAKYGPDRNVGFSPIPAMSMLSHAAGSRFMSLIGGPMLSFYDWYADLPPASPQIWGDQTDVPESSDWYNSGYIMTWGSNVPLTRTPDAHFLAEARYKGAKVISISPDFAESSKFSDDWLSIRQGTDGALAMAMGHVILQDFYVNQKTERFIDYAKQYTDFPFLVTLKEENGTFTAGRFLHAKDIGRATEHDEWKPAVWDEDTDGFAIPQGTMGSRWDGKGKWNLRMVDEDSEKPITPRLSMLGYEDMIGTVNIPYFSHDGNKVLERPLPIKKVILNGEEVFVSTVFDLTLANYGVNCGIGGQTPASFDDPEPFTPAWQEPITGIKSEMVIKIAREFAQNAIDTEGRSMIIVGAGINHWFNSDTIYRAVLNLVLLVGAQGVNGGGWAHYVGQEKLRPAEGWQTIAMAKDWGGPAKLQNGTSFFYFATDQWRYEDQEISGLASPIAKTSRYKHHADYNVLAARLGWLPSYPTFEKNGIDLYKEAEKAGAENAQQVGIYIARQLEEKKLKFSIEDPDNEKNFPRNLFVWRANLISSSGKGHEYFLKHLLGTTNGLMNDDQDSIRPEEITWRDKAPEGKLDLLINLDFRMAGTALYSDIVLPAATWYEKHDLSSTDMHPFIHPFNPAISAPWEAKSDWDIFKALAKAVSDLAEEVDMEPVKEAVATPLLHDTPQEMAQPLGKIKDWSKGDCPAVPGKTMPQIHVVERDYKQIFNKMTSLGPNVVKQPFGTKGMNWSVEAEYNSLKKTLGVVKDDTIAKGCPDISDARQAAEAVLTLSSTSNGKVAVKAWESLEKITNLELKDLAEEREEECFTFEQISAQPKTVITSPAFSGSEKGGRRYSPFTTNVEKLIPWRTLTGRQSFYLDHEMMTEFGENMATFKPILIHRPFLNKRPDQEGKEIVLNYLTPHNKWSVHSMYFDSLPMLTLFRGGPTVWMNKDDAEETDIQDNDWIECFNRNGVVVARAVTSHRIPKGMAFMHHAQDRHINVPGTKLTNNRGGTHNSPTRIHVKPTQMIGGYGQLSYGFNYYGPTGNQRDLNVVIRKLKEVDWLED

SEQ ID NO: 6168 - protein, 380 aa, Bacillus licheniformis
MSEIINNRETQQGLPEEKKQLLKEIIIDLHKGKPLADVKKRFEKAFGSVNAEEIAQLEQALMKEEGITPEEIQELCSVHAAVFKGSIEDIHRADADKQPGHPVHTFMKENKEIDLLLNFKMQLHLERFEKEDHRDNILKLLADLNLLADVDKHYSRKENLLFPYLEKYGITGPSQVMWAVDDFIRKSIKEVKRLLEEYTPDKKDEVIRELTFIIQEGTEMIYKEENILLPMALRTLTEDEWLKIAAESDEIGYCLTAPETVWKPERHQIKTSEEAADGYVRLPTGILSVDQLEHMMNHLPVDITFIDENDVVRYFSHGKERIFARTKAVIGRTVQNCHPPASVHIVNKLLDDFKSGKKMLKIFGSNLKTIRVHPLFCRTR

SEQ ID NO: 6169 - protein, 80 aa, Bacillus licheniformis
MHKKIDLDDSVYKLCTLHPELKAVMKDAGFQNITKPGMLETAGRIMTIPKGARMMQIEWNHVLDILKAHGFDPVWKGEKQ

SEQ ID NO: 6170 - protein, 367 aa, Bacillus licheniformis
MILCDFDKSPFIVIWELTRACELKCLHCRASAQNKRDPRELSLKEGKDLIDQIHAMDNPLLVLTGGDPLMRDDVFAIIEYAVQKGVRVSMTPSATPNVTREAIQSAKEIGLSRWAFSLDGPTREIHDHFRGTDGSFDLTMKAIRYIHECQLPLQINTVISSYNIDYLDEMAKLIKELNCVLWSVFFLVPTGRAKREDMISPVDHEKVFLWLSRLAKEAPFDIKTTAAQHYRRVVIQQKMREAKDPHMKIRYEHALQKGKMDAIGGLGRAPKGVNDGNGFMFISHIGDVYPSGLLPVKAGNIREQPLAEIYRESPIFKDLRNPDGFKGKCGVCEFRHVCGGSRSRAYALTGDYLESDPSCIYIPKALR

SEQ ID NO: 6171 - protein, 155 aa, Bacillus licheniformis
MDRFDYLLFLKNLPMFFGVPLPIIKKLLKNGKVIDIQPSQHSRSFLHSQSVYFVLKGEVHFSDRRLPEESRTIAEWEKGDVFPIDQKGEPFLSPFISVNTASETAVLEIPFHNFKKMMTYNRQLQTNFLMLLQQNLFFSYQLFLRYLNSSAEDDV

SEQ ID NO: 6172 - protein, 240 aa, Bacillus licheniformis
MKVFIPKQHGAWAMLVIPFILGMFAGGADVKHIPLFCGWLFLYLAASPAMMMVKKKNIVYYQKWVLIYGIPAVVFLLISVLLEPQLVYLGLPLFPLFLINLYYAKRNNDRALLNDIAAILVFSTGGLASFWMGAGKLDGEASFVFIQSALFFTGSAFYVKSMIREKKNNRFKLYSWGYHVFLPFVSLAAGAGWAVIGVVPSSLRAWFFHGRKLSIKIIGISELVNACIFMAVLIVFLLQT

SEQ ID NO: 6173 - protein, 237 aa, Bacillus licheniformis
MNISVRKSDTDLLSDDLHHLLESISTRRKIRQDTFLFQEGMDAEELYLIQSGLVQIGKLTSDGKELTLRMCKKNDIVGELTLFTEDAKYMLSAKILSDGEVLVINKDKLEKELIQNGALTFEFMKWMSTHLRKIQSKIRDLLLNGKKGALYSTLIRLANSYGITRSDGILINIVLTNQDLAKFCAAARESINRMLSDLRKNGVISIEDSGKIVIHQINYLKREIDCENCPLEICNID

SEQ ID NO: 6174 - protein, 394 aa, Bacillus licheniformis
MANRQKIQLPLQSFSLVAGFMVWVLISSLMPHIKQDIALTDSEVSLVTAIPVILGSLLRIPLGYYTNRFGARITFMISFLLLLFPVFWISTADSLFDLILGGFFLGIGGAVFSIGVTSLPKYYPKEKHGFVNGIYGAGNVGTAITTFAAPVVAKTAGWENTVRMYIVLVAVFALLNFILGDRKETKVTVSVTEQMKAVYRNQTLWFLSLFYFITFGSFVAFTIYLPNFLVNHFGLDPVDSGLRTAGFIAVATFLRPVGGWLADKFNPLKLLMYVFAGCTLSGILLAFSPSLGLYGFGVLTVAVCAGLGNGIIFKLVPLYFSNQAGIVNGIVSAMGGLGGFFPPLILSSVFQATGHYAIGFMALSEAALASFVIVVWMYFQEVNKTSSKTKANHL

SEQ ID NO: 6175 - protein, 79 aa, Bacillus licheniformis
MFIKLTQEEKQAIIDEIKRFYVEERGEEVGDIAAIQMFEFVKEKLGPYFYNQALKDSRRVVEEKAAAIEEELFALERRL

SEQ ID NO: 6176 - protein, 222 aa, Bacillus licheniformis
MEFLKQFMIFSGLNDEEFKQIEQIAAKRTYQPRMFVFMEGEEREAVFFIKSGLVKAFKIDEDGNEQVISILQNGDMFPHVGFFDLSPYPATAEAVQETELIVIRIADFNELLMKFPEMTIKVMQIMGKKILDLQERIQGFISKDVQHRLTHVLMKLAAEHGIPQEKGVYISLPITNQDFANMVGTSRETINRTLNELKKKNLLTADRSGIFIHDTDWLNGCN

SEQ ID NO: 6177 - protein, 784 aa, Bacillus licheniformis
MEVQRKTVPVKKASKNGFLKSILVFTLIVSFSVLLLGGYWIFKGLAPRPVEVSGPNGEVLMTKSSISGGQAVFQKYALMVYGTILGHGSYMGPDYTAEALKIYTEGMQDFKAEAQYGKRFKQLSDEKQSTIRNHVIREMRKNRYDRPSDTLKLTDAQVYGLHQVRDHYRKVFTKGDGWGLEPGLIKESHMPERNRAWVDSEDQITQVSDFIFWTAWLSSTLRPGDDITYTNNWPYDEDAGNTMSFAAVWWSGASVTILILFVGIILFVFYRYKLGMKEAYQEGAFPVFDLDKQPLTASQVKTGKYFAVVSLLFFVQAMFGALLAHYYIEPDSFFGIDWIRELLPFSISKGFHLQLAIFWIATSWLGMGIYAAPFVGGREPKRQGLLVDILFWALIVLVGGSMVGEWLGAKGFLGNNWFLFGHQGMEYIELGRFWQVILALGMLIWLFIVFRGIKSGLKREPDKGGLIHLLFYSSIAIPLFYGAAFFFNPGTNITMSDFWRWWIIHLWVEGIFEVFAVVVIGFLLVQMNLVTKKSTVRTLYFQLTILLGSGVIGIGHHYYYNGSSEVWIGLGSVFSCLEVIPLTLLVLEAYEQYKMMKDGGHHFPYKATFWFLISTAIWNLVGAGVLGFLINLPAVSYFEHGQFLTPAHGHGAMMGVYGMFAIAVWLYTLRNIAKKEAWNDKWLKIACWSLNIGLFGMVFINLLPVGFLQLKKAFEDGYWSSRAPEFLQQDAVQTLLTWRAVPDTIFLAGIVILVVFSIRALFHLRKPTYREGEALPVKDIASDE

SEQ ID NO: 6178 - protein, 237 aa, Bacillus licheniformis
MEAVFDQNTKTGDIVTRFPRASRLLKEYRIDFCCGGNRPIGEAIKEQDLNEEEILARINTLYQETKALNAKETNWSEAPYSQLIDHVIHTHHAYLYEVLPELSGFVTKVYRVHGIHHPELAQVHQLFHQLKTELEHHLFQEEEHIFPKVMAYEETRSMDRLAEAVQTIDVLEQEHEAAGSILKELRRVTNDYTLPEGACTTYTLTYLKLDELETDLFQHIHLENNILFPRLEAEANQ

SEQ ID NO: 6179 - protein, 123 aa, Bacillus licheniformis
MEHISWLTFTMLILASYRLTHLIVFDKITEFIRKPFMKKKQTIDEQGHVETKKVPKSNFGYLLNCYWCAGIWCALIIAVGYLIAPKAIFPLILILSVAGGQAILETFVGVATKLVGFFSDLKK

SEQ ID NO: 6180 - protein, 534 aa, Bacillus licheniformis
MAAEKVFSKNKIIGGKRMSYMKRSISVFIACFMVAALGISGIIAPKAAAASKTPVAVNGQLTLKGTQLVNQNGKAVQLKGISSHGLQWYGDYVNKDSLKWLRDDWGINVFRAAMYTAEGGYIDNPSVKNKVKEAVEAAKELGIYVIIDWHILSDGNPNQNKAKAKEFFNEMSRLYGKTPNVIFEIANEPNGDVNWNRDIKPYAEEILSVIRKNSPKNIVIVGTGTWSQDVNDAADNQLKDGNVMYALHFYAGTHGQSLRDKADYALSKGAPIFVTEWGTSDASGNGGVYLDQSREWLKYLDSKKISWVNWNLSDKQESSAALNPGASKNGGWSQSDLSPSGKFVRDNIRSGSNGSSGDSGSNSKGSDQKDQKKDQDKPGQDSGAAANTIAVQYRAGDNNVNGNQIRPQLNIKNNSKKTVSLNRITVRYWYKTNRKGQNFDCDYAQIGCSKITHKFVQLKKAVNGADTYLEVGFKNGTLAPGADTGEIQIRLHNDGWSNYAQSGDYSFFNSNTFKNTKKITLYENGKLIWGTEPK

SEQ ID NO: 6181 - protein, 91 aa, Bacillus licheniformis
MKGDGCMNETLQQYMMLVKEHYDTINGPDYTGKEEDIEKRKEQIELYAKTLQQGFSTDDDYDEFADAVIKCAYGDLTVEELETVYRELTSP

SEQ ID NO: 6182 - protein, 168 aa, Bacillus licheniformis
MKDMIMKTDRLILRKMRRDDAENLLEIFSDPIAMEYYPSTKNEKQTLQWIDRTLENYEKHGTGLWVAEHKQTGEFLGQCGIVPQEVEGSNEMEIGYLFKRSVWKNGYATEAASACKQYGFESFHLKKIVSLPDAQNLPSRKVAERIGMTLEKTIHKWGKEIAVYSVYR

SEQ ID NO: 6183 - protein, 378 aa, Bacillus licheniformis
MKTYDAFPEPIGGYTVGRTQMDFEYTASDHSKRELTAFVYYPSDSSEGKTTSTYMFPEVYEMFNEQPLVTALKDVFSIDIKTQCYDDLALSGKEKRYPVLFYVCGGGGSPEWGTVICTDLASMGYVVVSIGHQNSTMYKRKDGRLFNVSKDFSDVIMAFSEDPEMLALAGKMEMRPDDETAIEMCHNVLTLPILAKLTEYSELQAEDVRYVADYLYKLDSGELNSIFKGRLLLDIGMGIVGHSYGGPTTAIVCRDDDRFACGIGLDSGAFGLLDSDLKKPFLLLFCEPNYNMNAIIGANNSMETYYFSVDRVAHLDYCDIVFTSVNEELRGERDAMEMRNLVTDYTKNFFDHYILLKAASVESLAYDGVDLIKKTSNK

SEQ ID NO: 6184 - protein, 305 aa, Bacillus licheniformis
MKKQLLDVAIIGGGPAGLNAALVLGRARKNVAVIDAGRPRNAVTRKAHGFLTRDGISPSEFRQIAKEQISAYPSVSFIADKAVSITKTGGHFQMTTAQGNTFASKKVLFAVGMKDQPLDIPGLAEVYGKSAFVCPYCDGWELRDKPLVIITKGDEAIHFASLISGWTNRFTICTNGPHQLTDEQCEELSRHRVPVFEAPIRCIDSDDGIVQQVVLEDGTTIPCKGIFFKTELVTGSDLPRAIGCDITESGTVVVDNFGKTNIPGIYSAGDAATKLHQAVVAASMGAMAAAAINNELNLEAWEQNG

SEQ ID NO: 6185 - protein, 296 aa, Bacillus licheniformis
MINEFFKETVWEEAWKEDQQTAVNKMKKAGMDKVHHFDLRAKSFNEQAFNEEGRKRTKRIMKWLEGQGVTFKDTSILDIGAASGGFTVPFAERGAEVTAVEPSLPLVELMKENITGITNGKVKIVAEPFEDIDIQAKGWGNAFDFVFVSMCPAIADWESVKRVLSCARQFCYISLSAGSREHSLLNEIWPLVSDQPLKNEHSEMAYLLHLLFLKGYTYESLVTREMKTREVSRETALNEVMDMLRMFGLPADDRNRKITAAYLERTYPNDKVEIRQGGRFGKVLIRLQNQNMYMNS

SEQ ID NO: 6186 - protein, 141 aa, Bacillus licheniformis
MIEVKNCAMKYSKATNYALHTMLFLAAGAPNTFVGVQQLAERQEVSPTYLSKILTKLAKAGMIESASGANGGYRLKRNWEDISFLDIIHAIEGTASLFDCNLNHGSECVIQKVMVSAEDEMENYLRQQKISDLAKKITVEL

SEQ ID NO: 6187 - protein, 468 aa, Bacillus licheniformis
MRKWYFILSACILVSVIIAFAYDKTGAKEAEPANSLYVSPDGNDQNEGTKEKPFRTLKQAAKKAVPGTTVMIREGTYHETLDVRESGSAEKPITFQNYENEKVVISGESVKDAEYETPLIQIHNQQYITISGLTIQDLSVSSEEATAMGIYVSGSSSHITIKNNHVRDIKTTADDGNAHGIAVYGSGSMKDIKIEDNTVEKLTLGASEAVVLNGNIDGFTVRGNVVRDNNNIGIDLIGYEGTAAQNDFVRNGIVENNTVYDNSTYGNPAYGDDYSAGGIYVDGGQSIDIKENTVYGNDIGIEATSEHKGKYADDIQITDNKVYENAYTGISIGGYDQKRGGTSHSVIAHNIIYRNDTKGLDGGQLLLQYDTKNNTIEKNIITASDSRIFIANDFTKNEGNKVNHNVYHKESGKDGLWIWKQNEYDSFSPYQNATNQDQDSIYADPMYRDESSHDFTLDPDSPAWSVIE

SEQ ID NO: 6188 - protein, 334 aa, Bacillus licheniformis
MAKKIPFSFILIIGLMLFALFFGAGNLIFPPMLGQMAGENVWTANAGFLVTGVGLPLLAITAFVFSGKNDLQSLASRVHPLFGIVFTTVLYLAIGPFFAIPRSGNVSFEIGVKPFLSNDAGPVALIIFTVLFFTVACLLSLNPTKIIDVIGKFLTPIKLTFIGLLVVTAIIHPIGSFQAPSEGYASHVFFKGFKEGYFTLDALVAFVFGIIIVNAMKEKGAASKKQLIIVCAKSTAIAAALLALIYSALSYMGASSVEKLGLLENGAEVLAKVSSYYFGPYGSVFLGLMITVACLTTSVGLITACSSFFHGLFPNISYKKIAVILSMFSTLVAI

SEQ ID NO: 6189 - protein, 352 aa, Bacillus licheniformis
MCNLHKTISTRVLSAPRAKAKFEQTTIERRELQPNDVLIDIKYSGICHSDIHSAYDEWGGGIFPMVPGHEIAGIVKAVGTSVKKFAVGDRVGVGCFVDSCGECEYCQSGEEQFCTKGVIQTYNCLDYDGNPTYGGYSQYIVVKEDFVVRIPDSLNLDVASPLLCAGITTYSPLKHWNAGPGKKVAVVGMGGLGHVAIQFAHAMGAEVTVLSRSLNKQEEALRFGADHYFATGDPAVFTELAGRFDLILNTVSANLDVDAYLSLLRADGTLVNVGAPAERDQYSVFSLIMGRRSIAGSLVGGIRETQEMLDFAAEHGLAPQIEVIGADQVDEAYERVLKSDVRYRFVIDVSTL

SEQ ID NO: 6190 - protein, 131 aa, Bacillus licheniformis
MGYSIKEVAEKVGLPTHTLRYYEKEGLLPFIKRDANGNRIFEEKDLSWLELVICLRKTDIALSELREIVNLTKEGDWTISKRKQILEKHKEKMLEKQRVLERAFLKIDEKIMYYDGLEKKNQAMSLKADEK

SEQ ID NO: 6191 - protein, 86 aa, Bacillus licheniformis
MLVTKSTVRLPRGLQARHTTLFVRKAISFKSEIVLAKNGQTANGKDLMEILQLGVQEGDEITLMVYGTDEQAAKETLEKFLLNVVP

SEQ ID NO: 6192 - protein, 345 aa, Bacillus licheniformis
MMFLFIFIIILAAAVLLFINLHPVFGGNPSKEQKKLYQSFDNYADGKFLNQTQEKMDMGGISGVFSMMRDAVSGGKERNPSDQIPVSEIDWNIVKSNEDSLTWFGHSAFLLSIDRKKILVDPMLGPIASPVSFIGSRRYSEDILHTVNDMPPIDAVLITHDHYDHLDYPSILKLKEKAGHFFVPYGISAHLIRWGIEKEKITELNWWDETEFQGLTIALTPSKHFSGRGLLNRNTTLWGGWVILGKHTRFYTSGDGGYDEHFKEIGKKYGPFDITLMEGGQYDRRWSGIHMTPEQSVQAHKDVKGKNMMLIHWGAFTLAYHGWKEPIERALNSQYSLPETFWWDI

SEQ ID NO: 6193 - protein, 150 aa, Bacillus licheniformis
MENMYTDNIWLEVDNMNIGKLSKYFLSLAIALATILSFHAVSANAASVGTIKPSECSTHIFTVYDETVGIGGSGRAHFYCGSINGGPQIEFSDEDLEVAVDDPFILHAYANPSMNSVDYEGRQKGDAEVTIYWKNKPEGTKYTFLLVQNK

SEQ ID NO: 6194 - protein, 353 aa, Bacillus licheniformis
MSDDVLFSVNQNGAAAIVLNRPKALNSLTYDMVRLIGEKLNEWETDQNVSIVVIKGAGPKGLCAGGDIKALYEARSSKQALQDAERFFETEYEVDMAVHRFSKPIIACLDGIVMGGGVGLTYGASHRIVTERTKWAMPEMNIGFFPDVGAAYFLNKAPGRLGRYLGLTASVIHAADVLYINGADAYMESGALERLLQAVEQTDWRLASVEEKLDQLIRESKTEPSQESTLARDQQAIDRHFKYDKLEEILQSLESEGSTFSSNVKKTMLSKSPFSLKITLKQLADGRQKTLEECFATDLVLAKNFLKHNDFFEGVRSVLIDRDQSPNYKYRNVSDVTDEAVDRFFQPSESVRF

SEQ ID NO: 6195 - protein, 261 aa, Bacillus licheniformis
MNLKYATLKTEHGITTVTLNNPPANTLSSSCIAELRSLFRELARDEETKAIIITGEGRFFVAGADIKEFVSKLGDQKQGLALAQGGQALCDEIEASKKPVIAAINGPALGGGLELAMSCHFRIVSDDATVGLPELKLGLIPAFGGTQRLRNITDTATALDLILTGRSLSAQEAVELKIAQMAVKGEELMKTAAAVASSFIEGKSMTSVRRAVECVVQGASESMEQALERERNRFAELFVTSDAKEGIHAFVEKRKPNFHHS

SEQ ID NO: 6196 - protein, 484 aa, Bacillus licheniformis
MITTNAKKMMNHIDGEWVNSLGAESEEVVNPANGNVIAYAPLSVRADVDRAVQAAKHAYQTWSLVPVPNRARLLYKYLQLLQEQKEQLADIITTENGKTLKDARGEVQRGIEVVELATATPTLMMGESLPAIAGGIDGSIWRYPLGVVAGITPFNFPMMVPLWMFPLAIACGNTFVLKPSERTPILAGKLVELFYEAGFPKGVLNLVHGGKDVVNGILENDDIKAVSFVGSEPVAKYVYQTGTANGKRVQALAGAKNHAIVMPDCHLEKTVQGIIGAAFGSSGERCMACSVAAVVDDIADDFMEMLVSETRKLKTGDGRSEDHFVGPLIREVHKQRVLDYIDSGIKEGAALAVDGRNPDVREGYFVGATIFDHVTPEMKIWQDEIFAPVLSVVRVQDLDEGIELANQSKFANGAVIYTSSGKSAQQFRDKIDAGMIGVNVNVPAPMAFFSFAGNKASFYGDLGTNGKDGVQFYTRKKVVTERWF

SEQ ID NO: 6197 - protein, 295 aa, Bacillus licheniformis
MKKIGFIGLGNMGLPMSKNLLQENFTVYGMDLNKEAELALHHAGGTIGISVEKMVEECDAILTSLPSSNAAEEVFLGKKGLVHLAEPGVLLIDTSTVAPELNIRIAEEAKSKGIDFLAAPVSGGVIGAVNRTLTFMVGGPKSVFDKALPVFNALGENIFHVNENIDSGTNTKLINNLLIGFYTAGVSEALHLAKNSNLDLDQLFEMLNVSYGQSRIYERNYKSFIADENYKPGFSLKLLLKDLGFALDLAEKNNVELPVSKILFGIYEEADQNGYGEKDMSVLYKKISEQKTTYQ

SEQ ID NO: 6198 - protein, 571 aa, Bacillus licheniformis
MGKAKLRWNEPLISQHESAAEGFTPEDFTEEDRLISKTTESFVKNEVMPLLESIDQQDHESVKKLFQKAGELGLLSIEVPEDCGGLSLSKKLSGLVAEKMGAGGSFSVSFNIHAGVGTLPYIYYGTEEQKQKYLPKLASGEWIGAYALTEPGAGSDALNAKTTAVLNREGTAWILNGEKQWITNAQVADVYVVFAKTAEGMTAFIVERSFKGVSIGPEEKKMGIKGSSTATLILEEVEVPSDNVLGHIGKGHHVALNILNMARLKLAFSNIGTAKQALNLAVSYAKQRKQFNKPIIGFSMIQEKIADMAVSIFGAESAAYRTADCLDNVLDSALPLDDRLRKLTNYASECAINKVYCSEILGRIADEAVQIHGGYGYMQEYEVERLYRDARISRIFEGTNEINRLTIAKLLMKEVQQNGISEPEAQLGSEGNRNRRFIQLSNRLFGKTLKALIRSRVNTQEDQEYARLLADMKKEIYVMESAARRTEKARQIYGGEKARLKEMMTNVICEEGYRRIEEMAVTALSSIASDEAERKLAFEEARSVSLPLFSNLFTQKREIAEKIAAHEKYTV

SEQ ID NO: 6199 - protein, 317 aa, Bacillus licheniformis
MTEPLFFEPVFKERIWGGTALASFGYDIPSEQTGECWAFAAHQNGQSVVKNGLYKGLTLSELWDEHRHLFGHIKGDRFPLLTKILDADQDLSVQVHPNDEYAKLHENGELGKTECWYIIDCKEDAEIIYGHHAKTREELVSMIENGKWNELLRRVKVKPGDFFYVPSGTVHAIGKGILILETQQNSDTTYRLYDYDRKDAEGNLRELHLQKSIEVIDVPSSPDRETVQYETSGDVKTAALIDCPYFSVEKWDVKGSACFKQDKPFLLASVIEGEGRIASGGHNFSFKKGDHMLLPWGFGEFTLAGHAECIVSSLSIE

SEQ ID NO: 6200 - protein, 647 aa, Bacillus licheniformis
MKLLAITSCPNGIAHTYMAAENLQKAADRMGVQMKVETQGGIGVENELTEQEIREADAIIIAADRSVNKDRFIGKKLLAVGVQEGIRKPEELIQKAIGGDIPVYRSAVKTEASAQTEKKQNPIYRHLMNGVSFMVPFIVVGGLLIAVALTLGGEKTPKGLVIPDDSFWKTIEQIGAASFSFMIPILAGYIAYSIADKPGLVPGMIGGYIAATGSFYGSGSGAGFLGGIIAGFLAGYAALAIKKLKVPKAIQPIMPIIVIPVVSSLIVGLAFVLLIGAPVAQIFESLTVWLAGMQGSSSILLALILGAMISFDMGGPVNKVAFLFGSAMIGEGNYEIMGPIAVAICIPPIGLGIATFLGKRKFQAQEREMGKAAFTMGLFGITEGAIPFAAQDPLRVIPSIMAGSMTGSVIAMIGNVGDRVAHGGPIVAVLGAVDHVLMFFIAVIAGSLVTSLLVNVLKKEVTAAPAGISEAAAGNDIPQPNIEIEAESKKIEKPEITKLTDIIDTDLIEPHLSGDTRDDIIDEMIQKLSRKGVLHSESEFKQAIINRELEGTTAIGMNIAIPHGKSDAVKKPSVAFGIKRSGVDWRSLDGTDAKLIFMIAVPKESGGNEHLKLLQMLSRKLMDDTYRDKLLSAQTKEEAYKLLDEII

SEQ ID NO: 6201 - protein, 96 aa, Bacillus licheniformis
MYNIKSNFSFPVTTIVLVVFVAACLHFDLVKRKKSKDQNDKKYEFIWWIATILMVLVMTLNTVFVKIDPKYNIIVVLIHILFMVIIKSRWKKAKTD

SEQ ID NO: 6202 - protein, 56 aa, Bacillus licheniformis
MDNQVLQAIYEMQKEMKEDFKSVNERLDTINKTLTRIEENDPEKVISMLKLINKKH

SEQ ID NO: 6203 - protein, 90 aa, Bacillus licheniformis
MNYDEAQHLHISYNKKGLDLEAVGLKRLDIDVWDVYFNFQDHGIDEPPLSFSKIDPFGCNILSITSKDLKINEATQYFELWIKHELYKDL

SEQ ID NO: 6204 - protein, 647 aa, Bacillus licheniformis
MNTRQKDILNLLLSEPDDYLVVQDFADRVKCSEKTIRNDLKTIEDYLNQHSDAQLIRKPGLGVYLNIEDQERVRLSRQLYTEHHAAQQLPDEERMLQIAYQLLMNPKPVSAKEMAAEHFLNKSSIKRDLNKIDVWLKRFGLTLVSKQRLGLKIEGSEKNKRKALARISELIDNPEFTSRFIKSKFLSHEVEFVKSEIRSLQRRHSLYFTDETFENLLLHTLLMIRRIKMKQPITISPGEIDAVKKKKEFQWTFACLKRLEAVFAIRFPEEEAVYLTLHILGGKVRYPFGKEGDSGLENPLLPKVVEYLINRVSELKMMDFREDRVLINGLKVHLNTVLNRLSYDLSVSNPMLNDIKKMYPYLFHIVIDALEDINQTFSLSIPEEEAAYLTLHFQAAIERFSYGKDKHKKAIIVCHMGIGMSQLLRTKIERKFHQIAVMDCIAKADLADYTARYKDIELVISTVSLEDLSIPHIVVSPLLESADEKKLSDFMDQLGESTRQKQKTFKVLNDTTPFLVFLQQESEHRYKLIEQLAIALYEKGYVEKEYAVHAVLREKMSATNIGAGIAIPHANAKLIKQSAIAIATLKEPLDWGSEKVSLVFMLAVKHEDQNMTKQLFQELSSLSEQPAFIQKLTKETNVMKFLSYLDY

SEQ ID NO: 6205 - protein, 218 aa, Bacillus licheniformis
MYHLIKKDILMQKRAMKLSLLLMIFFTFTLSQLELVGYTVAVLAVTYQLALGASSLEDKNNSDKILISLPIKRNIIVLSKYVSVYVYAAYAILFYSLINAVGHLLHLPLDFPLTFSGAMGAVVAVTLFSSISFPLIFKYGYLKSKMANILIFFFIIFGGTAFFKFIDADETLALSQKLTAFLSGMSNAGTFILLVGVLLVMISVSYAISLSFYNKREF

SEQ ID NO: 6206 - protein, 292 aa, Bacillus licheniformis
MTSILELKNVTKHYQDFSLKNINFSLEKGYIMGFIGPNGAGKSTTIKLIMNLIKKDEGNISIFGLDNEKHNIEIKQRIGFVYDENHFYEELTPNEMKGIIRPFYKKWDEAVFQRYAKDFQLPLNKQIKNLSKGMKMKFSLAVALSHHAELLIMDEPTSGLDPLVRSELLDVLQTLLQDENKSIFFSTHITSDLEKVADYITFIHNGRLVLSKTKDELLEEYCIVKGDLDTLRKGNEDALIGIKKNRYGFEALSRDKREVVQHFGDSVMIEKPTLEDILVFSTGRSDHRVSSN

SEQ ID NO: 6207 - protein, 124 aa, Bacillus licheniformis
MNIIISNSSDEPIYLQIVNQLKDQIVKGELSESEALPSIRNLAKELKISVITTKRAYDELEREGFIVTVAGKGSYVAAINKDMLRETKVKLIEEHIAEAVTEAKQIGFTYEELQEMLKLVYEEW

SEQ ID NO: 6208 - protein, 283 aa, Bacillus licheniformis
MQIPFHVNLKDKVAVVTGGSGILCSGFAKALAQCGAKVAVVSRRAESADRVARDIQENGGEALAVTANVLDKQSLEQAKQLINRTFGRCNILINGAGGNHPMGTTDKEYLYKKDLNTKELTTFFDLEIEGVRSVLDLNFLGTLLTTQVFAKDMADHDGNVIVNISSMNAYTPLTKIPAYSGAKAAVSNFTQWLAVHMSKVGIRVNAIAPGFFLTAQNRSLLLNEDGTYTERAQKIINQTPLDRFGVPEDLIGTLLWLVSDKASRFVTGTIIPVDGGFSAYSGV

SEQ ID NO: 6209 - protein, 368 aa, Bacillus licheniformis
MLNNKREEDGGTMQMTFRWYGDSDPVTLEYIRQIPGVTGIVSAIYDIPVGEAWPYEKIVELKEKIENHGLSLSVIESVPVHEDIKLGLPTRDQYIENYKTTIRNLAKAGVKIVCYNFMPVFDWTRSSLDYALEDGSTALIYEEEKVRQMNPLHGELKLPGWDTSYEDGQLKNLFQQYQHMTEEDLWENLSYFIKAVIPAAENEQVKMAIHPDDPPWPIFGLPRIITNKENLERLIHLYDSSFNGLCLCSGSLGVKSTNDIPELIRYFGKKGKVNFVHLRNIKIIGEKSFQESSHRSEDGSLDMYEIVRALRDIDFAGPARPDHGRMIWGETGKPGYGLYDRALGAVYLNGMWETLTKEKKRIALECNK

SEQ ID NO: 6210 - protein, 802 aa, Bacillus licheniformis
MSIKETYMFTFMKEENNVLDFHLNDGHAHAKIFILEEDIIRILLTEGEALTLEKTWSVAPGQIDVPWEGRHRLDMSGFTLPQYEFQQVKDVFIVKTGKVKLHVQLNGFRISWFYHNGSEWINVANDRQTQGYNFEGAFGKGVYHYLQRDVQEQYFGFGEKTGNVDKHGKRYRMLNIDAMGYDAERSDPLYKHIPFYITRHKKTGISYGMFYDNLSASIFDMGSELDNYHGLYRYYQAEKGDLDYYFIAGPKIKDVVETFSWLTGKTILPPKWSLGYSGSTMSYTDAPNAQEQLKNFVRLCEEHDMLCDSFQLSSGYTSIGDKRYVFNWDEIKIPAPKEMVQHFHEKGVRLCANIKPCLLKDHPYFDELQEKDMFIVNRETQKPEMAQFWDDIGAYLDFTKRQTFDWWKAQVTEKLLEYGIDSTWNDNNEFEIWSQNAKCHGFGKEVEFELIRALHPLLMMKASFEAQLEYNPELRPYLISRSGCPGMHRYAQTWTGDNRTSWKTLKFNIKTGIGLSLSGIYNFGHDVGGFSGLAPEPELFVRWVQNGIMHPRFTIHSWNDDGTVNEPWMFPETIDEIRELIKFRHKIIPYIYTALYEAHEHYQPIIRPTFYDFEHDEKTFEENDEFILGESLLVASVVEKGMTEREVYLPNHEKGWYDFHTGTWYEGGKTVVLPAPLHYTPLLAKAGAIVPVNDAKVTFQTKNQDERGFLLFPFKGKGKSTYRLYEDDGLTNEYTHTFAFIHVDMETTEDGIKLSIQKEGTYELSYDQLTFHVPNGEKRKLIVNGTELESKNGAFSYSLPCD

SEQ ID NO: 6211 - protein, 431 aa, Bacillus licheniformis
MAIAAGLILSAVFFILLFLGVPISVSIAAASIVTMLTIFPFDVAIFTSAQKMVTGIDSFALLAVPFFILSGIIMNNGGIAMRLINFAKLISGRLPGSLAHTNVVGNMLFGSISGSSVAAAAAIGGVMSPLQEKEGYDRTYSAAVNIASAPTGLLIPPSGLLIIFSLVSGGTSVAALFMAGYLPGILWGLATMVVACMIAKKKKYPVAPKITISQGFKVLLDAIPSLLLIVIVIGGIIAGVFTATEGAAIAVAYSLLLSLFYRTLKWKQLPKMLLETVEITAVIMFLVGTSTMLSLVMAFTGIPTAISNGILGITDNPILILLMMNIILLIIGTFMDITPAVLIFTPIFLPIVESFGMDPVHFGIMIVFNLCIGNITPPVGSALFVGCSIGKVDIERVVKPILPFYAAIMIVLLIVTYIPQISLVLPQLFGL

SEQ ID NO: 6212 - protein, 171 aa, Bacillus licheniformis
MLALKKAVNKTIECLTCTLMAIMVLVAIWQVFTRYVLNSPSTFSEEFLRYSLIWISMLGGAYAFWKKKHLAIEFIVRKLPIKAAVFVHTFIQILLIAFALIVLVLGGSKAVITTMEQSSAALGIPVGFVYLSLPVAGILIIGYSLAGLYESLHEFNSKQKSGDDVKKAAKM

SEQ ID NO: 6213 - protein, 333 aa, Bacillus licheniformis
MRNMLSVFFVCALIFGMLTGCKSSDVIGVDKTVTLRLAHNHNEEHPIHKSLLKFSKDVEKKTNGTVKVQVYPNAQLGSEREVIELTQTGAVDLAKVSASALESFSEVYSIFSLPYLFDSKHHFYEAMDSDIAKEMYDTTKNIGFIGLTYYDAGLRNFYTKNKPIMHPNDLKGLKIRVQPSATAIRMVELMGGAPTPMAYGEVYTALQSSVIDGTENNEMALTSSNHGEVAKEYSYSEHAIVPDILIMNLDKKDQLSEEQQNAVIEAAKESTEYHKIVWAEETENAVEKAKEMGVKFHKPDKTPFRDAVSPLHDEFAKKELIGKYYREIRKLKK

SEQ ID NO: 6214 - protein, 336 aa, Bacillus licheniformis
MTVTIKDIANASGVSYSTVSKALRNSPLVKPDTKKKVLQVAEQLGYSPNFAARSLASKKSQTIGLVWPTIERIALSALVTKINEVVEKNNYSMILSVNRAKEAVDLFKSFRVDGIMIFEEGGETQLSDDTGLTIPILSYGVSGEHTHPIIDVNHKKAIYKAVAYLYQLGHKNISYVGDLSPADKRQVEKSKGFEEVMMEAGLKLSRNSILNTNGLSWYNGYTAAKKLLQQTPKPTAIISGSYDISVGILRAVKEQQLSIPEDLSLISYDNIPQMASLETPLTSVGVPIDQLAHKMVDSLLSLIREPGSIPLTQKMDPELNVRMSCASPAVLGEENK

SEQ ID NO: 6215 - protein, 139 aa, Bacillus licheniformis
MSKKTIYFLCTGNSCRSQMAEGWAKKHLGDEWNVYSAGIEAHGLNPNAVKAMREAGIDISEQTSDIIDPDILHNADLVITLCGDAADKCPMTPPHVKREHWGFDDPAKAEGTEEEKWAFFQRVRDEIGERIKRFAETGE

SEQ ID NO: 6216 - protein, 431 aa, Bacillus licheniformis
MTTVLATLIFLLTLTLVIWQPKNLSIGWSACGGAVLALIAGVVNFQDVLDVTGIVWNATLAFVAIIIISLILDEIGFFEWAALHMAKAAKGNGIRMFVYVTLLGAVVAALFANDGAALILTPIVLAMVRALNFQEKLVFPFIIASGFIADTTSLPLVVSNLVNIVSADFFNIGFIEYATRMIVPNLFSLIASIIVLFLFFRKSIPRHYDMTNVKQPAEAIRDRKIFRLSWLILAVLLAGYFISELFSIPVSIIAGVIAVIFLITAKNSPAVQTKKVLKGAPWAIVFFSIGMYVVVYGLRNAGLTDVLSQVIQTVSDQGLFAGTMGMGFIAAILSSLMNNMPTVMIDALAIQNTDTHGILREALIYANVIGSDLGPKITPIGSLATLLWLHVLSLKGVKISWGTYFKTGVILTIPTLFITLAGLYVWLLIIH

SEQ ID NO: 6217 - protein, 115 aa, Bacillus licheniformis
MSVQTKLDSKSTVSCMKILSDSTRLLILKLLQEKPYCVCQLVDMFETSQPAISQHLRKLKSANMIKEQRREQWRFYSLHDDFPERELVLAVLNQIDAHDEVLQTVKRKERPVSCS

SEQ ID NO: 6218 - protein, 197 aa, Bacillus licheniformis
MTNSRTNPKVDEFLSKAEKWKEEFKKLRQIVLECELNEDFKWKHPCYTFENKNIVLIHGFKEYCALLFHKGALLKDPNGILIQQTENVQAARQVRFTNVQEIAEMETILKAYINEAIDVEKAGLQVDFKQAAEYTIPEELQKKFAEIPALKAAFEALTPGRQRAYILYFSKPKQSKTRESRIEKYTQQILDGKGLND

SEQ ID NO: 6219 - protein, 251 aa, Bacillus licheniformis
MLSKRRGGMIMKFSIMTFNIHHGKGRDRRVDLGRTAGVIAQSGCDIIGLNEVDRHFSNRSDYEDQIGRLAEQLNMHYAYCPSLSLSSGDSSEKRQYGNALLTRFPIKKERHHSFNFVKGLIEGRSLLEADVRIGDRLFRVFVTHLSLNPWLHGKQTDFLIEKVQESDLPVIVTGDFNMKPYSRGWKKVAEKLADLWDESQYGQGFTHPSHRPRRRLDYIFLSPSFHVSAAEIVAVDPNASDHLPLKGSITY

SEQ ID NO: 6220 - protein, 285 aa, Bacillus licheniformis
MDIFLAILPAIFWGSIVLFNVKLGGGPYSQVLGTTFGALIFSIGIYFVVQPELSPRIFAVGVVSGLFWALGQTNQLKSIDLIGVSKTMPISTGLQLVSTSLFGVLVFHEWATTISIVLGVLALIFIIVGIVLTSLEDRSQKTEEKTGDMKKGIVILLISTFGYLVYVVVVRLFDVSGWAALFPQAVGMVAGGLILTFRHKPFNFYVIKNIIPGLIWAAGNMFLFISQPRVGVATSFSLSQMGIVISTLGGIILLGEKKTKRQLIGIAIGIILIVAAGVLLGIAKA

SEQ ID NO: 6221 - protein, 395 aa, Bacillus licheniformis
MKEKSAGCETKEFRAVWIATVTNIDWPSKKGLTIEEQKTEYVKLLDDVTAMGMNAVVVQIKPAADAFYPSAYGPWSEYLTGIQGKDPGYDPLAFLLEETHRRKLEFHAWFNPYRITMNHTDLNRLSQDHPARTHPDWVVAYGRQLYYNPGIPEAQEFIVQGIAEVVKNYPVDAVHMDDYFYPYKIAGVEFPDLSTYEQYGKDRFSNIEDWRRDNVNQLVKQINDAVKKERASVKFGISPFGVWRNIADDPTGSNTAAGMTNYDDLYADTREWIRQGYIDYIAPQIYWSIGFAPASYDILVDWWKNEVSHRPVHLYIGQAAYKINQNSDPAWSDPEEYPRQIALNRASNVMGSIHFSLKDLNRNPLGIKDRLIQDLYKKPAAVPDMPWLGSVNSEN

SEQ ID NO: 6222 - protein, 400 aa, Bacillus licheniformis
MYHLYTHNDLDGVGCGILAKVAFGERVEVRYNSVTGLDMQVGRFLERTKGKEKQHEGLFITDLSVHQENEERLDQYAEAGGKVKLIDHHKTALHLNERPWGMIKVQYEDGRLASATSLFYEYLIDNGHIRETKAMDQFVELVRLYDTWEWEQTGALEAKRLNDLFFMVSIDEFEEKMIRRLKESDAFSFDEFEEKILDMEEEKIERYIRRKRREIVQTFINAHCVGIVHAESYHSEVGNELGKTYPHLDYIAILNMGGKKVSLRTIHDETDVSEIAGTFGGGGHAKAAGCPLTDEAFKLYVTEPFPLEPLRADAFKNVYNVKKSDYGSLYVNRDEDQFFLFPSANGWNIQLNGVAQHETFTSFEEAERFIKRNYAAWLARDEAFVQYLMQQVKLAIQTTG

SEQ ID NO: 6223 - protein, 252 aa, Bacillus licheniformis
MDGNIHSIETFGTVDGPGIRYVVFTQGCLMRCQFCHNADTWEIGTGKQMTVSEIVQDVQHYLPFIQSSGGGITVSGGEPLLQLPFLIELFKACKSLGIHTALDSSGGCYSAAPAFQEQIKELIQYTDLVLLDLKHHNRKKHINLTGMPNDHILEFARFLAEHQVPVWIRHVLVPGISDIDADLTALGTFIGTLANVQKVEVLPYHKLGVYKWEALGLDYPLKGVEPPSADRAENAYRLLTAHLQGGSLLQET

SEQ ID NO: 6224 - protein, 741 aa, Bacillus licheniformis
MEQWKGFTTNVWQKEVNVRDFILSNFEPYQGDESFLEPPTEATSALWDHVMDLTKKERENGGVLDMDTEIVSTITSHGPGYLNKDLEKVVGVQTDEPFKRSLQPFGGIRMAKQACESYGFKLNEEVERIFTDYRKTHNQGVFDAYTDEMKLARKVGIITGLPDAYGRGRIIGDYRRVALYGVDFLIDEKKKDAAGTSRVMSEENIRLREELSEQIRALNELKALAKSYGFDISKPAANAREAFQWLYFAYLAAIKEQNGAAMSLGRVSTFLDIYIERDLKTGVLTEREAQELVDHFVMKLRLVKFARTPDYNELFSGDPTWVTESIGGMAHDGRALVTKNSFRFLHTLDNLGPAPEPNLTVLWSVRLPQKFKNYCAKMSIKTSSIQYENDDIMRPEYGDDYGIACCVSAMAIGKQMQFFGARANLAKALLYAINGGKDEKHKMQVGPEMPPVASDVLDYDEVMHKFDQTMEWLAGLYINTLNVIHYMHDKYCYERIEMALHDTEILRTMATGIAGLSVVADSLSAVKYAKVSVVRDENGIAVDFETEGDFPKYGNNDDRVDAIAVDIVKRFMKKLRKHQTYRQSVQTMSILTITSNVVYGKKTGNTPDGRRAGEPFAPGANPMHGRDTKGTLASLSSVAKLPYSYALDGISNTFSIVPKALGKDEESRAANLSSILDGYAAKTGHHLNVNVFNRETLLDAMEHPEEYPQLTIRVSGYAVNFIKLTKEQQLDVISRTFHESM

SEQ ID NO: 6225 - protein, 489 aa, Bacillus licheniformis
MKKHMKLCLCMMMIFVLTLAGSMDGLGAEEKGGLKEQIDQLLKTEPDLKGALAGISVRSAESGKMIYGHMGDTRMRPASNLKLLTAAAAYSVLGEDYTFPTEVMADGARAAGTLKGSLYIKGKGDPTLLTADFQQMAKALRKQGITVIRGDLVGDDSWYDEIRYSQDLSWTDEDAYYGAQISALTVSPNEDYDAGTVIIDVNPAGKTGKKPAVLLTPQTNHVKIKNDAKTVAADGKKDITIKRKHGGNTIQIKGTIPQGASRVRQWVAVWEPSEYALDLFKQALHQQGIRILGKTKIGKAPKTAHRITTHQSMPLSELMIPFMKLSNNGHGETLIKEMGRAARREGSWDQGLEVLNTELQRFGLDTEKIVLRDGSGISHINLISAHQITKLLYSVQDEKWFPSFARSLPVAGESDRMVGGTLRNRLKDPALKGKVRAKTGSLSTVSSLSGYVDTASGKTLIFSILLNQLVDDEKGKDIEDKIVQILASS

SEQ ID NO: 6226 - protein, 392 aa, Bacillus licheniformis
MSKHIVILGAGYGGLLSALTVRKHYTKEEAKVTVVNQYPTHQIITELHRLAAGNVSEQAVAMPLAKLFKGKDIDLKIAKVNSFSVDKKEVALSDGSTLTYDALVVGLGSVTAYFGIPGLEENSMVLKSANDANKIFKHVEERVREYAKTKNEADATILIGGGGLTGVELVGELADIMPSLARSYGVDPTEIKLKLVEAGPKILPVLPDELIERATKSLEKRGVEFLTGLPVTNVEGNVVDLKDGQKIVTNTFVWTGGVQGNPLIGESGLEVNRGRATVNDFLQSTSHEDVFVAGDSAVVFGPDGRPYPPTAQIAWQMGELIGYNLYAYLENKSMATFSPVNSGTLASLGRKDAVAVIGANSTSLKGLPASLMKEASNVRYLSHIKGLFSLAY

SEQ ID NO: 6227 - protein, 144 aa, Bacillus licheniformis
MPETIDQTADQTNESVSQSQRDLIDQLLKPEVQESLTVLVDQLPKLTELVNILTKSYDFAQSVATDEVLKNDTVGAITEILEPVKDTAKEIAATAIEAKDRADESNEVIGLFGLLKMLKDPQAQKLFRFVQSYLQIMSEREKQK

SEQ ID NO: 6228 - protein, 107 aa, Bacillus licheniformis
MKEALYIKFSMILFHFRNNHVHFLFKKCYHLVVKNTACFEIAGFREFQTENSKTNTKGESLFADLFVHKFTNYKKGLPSKNSTSLIEKENWLCRKQSIKQLIKQTNL

SEQ ID NO: 6229 - protein, 76 aa, Bacillus licheniformis
MYLTIKETAEYLTLSEAYVEQLVREKKIRTVFDGQQHLINKEQFNTHMEQMEKYKEWAESVLNEPIPEDPDVKDED

SEQ ID NO: 6230 - protein, 74 aa, Bacillus licheniformis
MYSKWNSETSYPPSAPQMHTGQSSQQMNQRLKNLEDQMELLIKLMESNNQLLRSIEEQQNRVCTAGGGSVIVRM

SEQ ID NO: 6231 - protein, 650 aa, Bacillus licheniformis
MGEKAVWQPDPEFVKTTRLFQWMTALGFSDYDDFLKASTNDIAWFWEEAEKALGISWYKRYSQTLNLDKGIKWPQWFTGGRLNAVYNAVEKWARRPDTAGRTALIWESEDGKTEQITYSSLHQQVARAAAGFKKQGISKGDVIAIYMPMIPETVIAMLAAAKIGAVFSPVFSGYGAHAAAARLTAAGAKILVTADAFLRRGKKVCMKKEADKAADRSPTVQKVVVCKLHGGDQDWNYKRDIDWNELMKNEPMQNTEEMDSSDPLMLLYTSGTTGQSKGAVHTHAGFPLKAAFDAGFGMDVKQGDTFFWFTDMGWMMGPFLIFGGLINGAAVLLFDGAPDYPAPDRLWELVSRHRVTHLGVSPTLIRSLMQHGEDFLYQYNLNSLKAIGSTGEPWNYEPWMWLFRHVGKERIPIFNYSGGTEISGGILGNVLLRPITPMTFNSPLPGMAANVFNEKGEEVVNEVGELVLTKPWVGMTNGFWKEPSRYEEAYWSRWTDVWVHGDWAKRDENGYWTISGRSDDVINAAGKRIGPAEIESVLVGHPAVAEAGVIGVPDKLKGQAAVCFVVLRQSEKPSEELKDDLLNLASDAIGKAVKPKAVYFVSGLPKTRNAKVMRRLIRAAYMNEPAGDLSTLENRETYDEIAGLSVRKNL

SEQ ID NO: 6232 - protein, 509 aa, Bacillus licheniformis
MPAEKELYERIRRIQEGGAEKYHEANKKKGKLFVRDRLKLLLDEGLDLEDAFFANCMADGLPADGVVTGIGKIGGRTVCVMANDSTVKAGSWGARTVEKIIRIQETAEKLNCPLLYLVDSAGARITDQVDMFPGRRGAGRIFYQQVKLSGRIPQICLLFGPSAAGGAYIPAFCDIVIMVEGNASMYLGSPRMAEMVIGEKVSLEEMGGARMHCSVSGCGDILADTEEDAIKSARRYLSYFPSNYTEKAPVIEAKSARPFDRSLEDIIPKNQNAPFQMMDLIDRIIDEASFYEIKKLFAPELITGLARIHGQPVGIIANQPRVKGGVLFHDSADKAAKFINLCDAYHIPLLFLADIPGFMIGTKVERAGIIRHGAKMISAMAEATVPKISVIVRKAYGAGLYAMAGPAFEPDCCLALPTAQIAVMGPEAAVNAVYAKKIAELPEEERSAFIAEKRKEYQKDIDIYRLASEMIVDGIIPADSLRTELIKRLNAYMTKYMTFTERKHPVYPV

SEQ ID NO: 6233 - protein, 260 aa, Bacillus licheniformis
MEPNVLYSINEQSVAVLTLNRPQAANALSLGLLDDFQRILRDIRSNPAVRCVIITGKGDRTFCAGADLKERARMSQTEAKQAVSLIQRVVSETEKLPQPVIASLNGSALGGGLELALACDIRIAAEHIELGLPETTLAIIPGAGGTQRLPRLIGRGKAKEMIFTGCRISAEEAQKISLVEHVVPLSKLKEASESIAANIAANGPVAVRQAKFAINQGLETAIETGLAIEQKAYELTIPTKDRTEGLKAFAEKRKPDYTGE

SEQ ID NO: 6234 - protein, 303 aa, Bacillus licheniformis
MDVPKNIFIKEVGPRDGLQNEQTALSTADKITWIDMLSATGLSYIEITSFVHPKWIPALSDALDVAKGINRKPGVTYAALIPNRKGLERALEGGIDEASVFMSASETHNRKNINKSIGETLPVLKEVIGAAKQAGLTARAYLSTVFGCPYEHHVPLEQIIRTSETLFDMGINELSLGDTIGAANPVQVQRVLEVLLKRFPKENIALHFHDTRGMALANMIAAMDMGITVFDSSCGGLGGCPYAPGATGNAATDDLIYMCAQMGIETGVDLSKLLSAAKWIEDKTGRELPSRNLQAAKSKNCFH

SEQ ID NO: 6235 - protein, 70 aa, Bacillus licheniformis
MNTVVTNMAGNVWKILVKAGDKIEKGQEVAILESMKMEIPIVAETAGTVKTVRKNEGDFADEGDVLLELQ

SEQ ID NO: 6236 - protein, 446 aa, Bacillus licheniformis
MFKKVLIANRGEIALRIIRTCQRLGIQTAAVYSEADAESLHVKAADEAWLIGKPRVSESYLNIEKIIETAKKAGVCAIHPGYGLLSENSRFAERCLKENITFIGPPPDVIAKMGSKIEARQAMEQAGVPVVPGVTKSLSGLNEARALAESIGYPVMLKASFGGGGIGMQLIRNESELEKAYEGNQKRAADFFGDGAMYIEKYIEQARHIEIQILTDKYENAVYLWERDCSIQRRQQKIIEEAPAPLFDETMRTKLGEAAVKAALSIGYVNAGTIEFLVDKENHFYFLEMNTRLQVEHPVTEEITGLDLVEEQLNIAAGKPLSHKQKDIRRDGHAIEVRICAEDPKTFFPSPGRITDLKLPEQPNVRHECAAAPGMTITPYYDPMIAKMIVKGSSREEAICTLAEALSQYQVKGIKTNIPLLEDIVSSDEFRKGGVQTDFISRYQSK

SEQ ID NO: 6237 - protein, 545 aa, Bacillus licheniformis
MAELLHLTIGKLLEKTAADAPDHEAVVYPDRGLRYTYREFDQLCRKVAKGLMALGIDKGEHVAIWASNTPEWLTAQFASAKAGAVLVTANTNYQLSELEYVLKQSDATTLILMESYRGTSYIDILCKLIPELKEGEPGRLASERLPFLKNIILLGDQRHPGMYLWDDLLKLSGSVSEKALDRRMERLKEHDVINMQYTSGTTGFPKGVMLTHSNLANNAANIAECMNLSKKDRMCIPVPFFHCFGCVLGTLACVTAGATMVPVQEFSPKEVLSAVETEKCTALHGVPTMFIAELNDPDFASYDLSSLRTGIMAGSNCPIEVMKKVIDNMGMSEITIAYGQTEASPVITQTRVNDSLKRRVETVGRALPNVEVKITEPGTNREVERGVQGELCTRGYHVMKGYYKNPEATAAVIDEDGFLHTGDLAVMDEEGYCRITGRLKDMIIRGGENIYPREIEEFLYKHPDILDVQIVGVPDETFGEEVSAWIKLKSGASMTADELKEYCKGKIARYKIPRYIAFVEEFPMTASGKVQKFKLREQALEHFQL

SEQ ID NO: 6238 - protein, 386 aa, Bacillus licheniformis
MNFELTREQQMIRELARDFAKQEIAPHAEHVDRTGEFPIETFKKMGELGLLGIPFPESYGGSGGDTISYALSVEEIGKACGSTGLSYAAAVSLGAAPIYYFGTEEQKQEYLVPLATGRALGAFGLTEPNAGSDAGGTRTKARSEGDSYVISGEKCWITNAGFARTVIVTAVTGIDDNGKNIISAIIVPTDSEGFTIKSEYDKMGVRGSNTSQLILDNVRVPKQNLLGSPEKGFKQFLNTLDGGRISIAALAVGIAQGAFEAALTYARERKQFGRPISYFQAIQFKLADMAMEIELARNMVLKAAWLKDQGRPFTKEAAFAKLYASEMAFRTCNQSIQIHGGYGYMKEYGVERMLRDAKLMEIGEGTSEIQRLVIARQLGIGKQALK

SEQ ID NO: 6239 - protein, 186 aa, Bacillus licheniformis
MKTLVIVAHPNLETSVVHKRWVEELKKYPEKYTVHELSDVYPDGNIDAEKEQKLVESHGNLVLQFPIYWFNCPPLLKKWLDDVLAYGWAYGSNGGDRLNNRKVALGVSAGIKEEDYRENGRYRYTLEQILVPFETTFRYCRADYRSFFAFYGKEKEPGGNEEEENEPGAGELEKSARDYLHFIDHM

SEQ ID NO: 6240 - protein, 116 aa, Bacillus licheniformis
MQIPSGKTCVPTGVELKDTGFGYTLSLISGKYKIVILYWLSEREVMRHNELKRSIGTISFKTLSIMLKELEADGLIIRREFPQIPPKVEYSLSERGRSIVPLLNMMCEWGEKNRLG

SEQ ID NO: 6241 - protein, 423 aa, Bacillus licheniformis
MTATSESISAQIEEKAIKAKTAAKSLRLATEKEKNEALAALADHLKQNMSYILTENAKDIEAGRKKGYDAAYIDRLSLNEDRVLDFADGLLEVAELDDPVGETLSSWTLDNGLKAEKVSVPLGVIGMIYEARPNVTVDATGLALKSGNAIVLKGGSSAIHSNTAIVSVMHQALDSTNIPRDAVQFIESTDRSATKQLFKMKEHIDVLIPRGGGALIQEVVENATVPVLETGVGNCHIYIDREADPEKAIDVMINAKTDRPAVCNALETLIVHEKWLEENSAALINALNEHGIQVHGDEKAVQMIPGARPAGEADWQNEYLSLDLAVKVAGSLEEACDHIETYGTKHSEAIITENPETAKAFLNTVDAAALYHNASTRFTDGGALGFGAEIGISTQKLHARGPMGLKELTTCKYIMRGDGHIRR

SEQ ID NO: 6242 - protein, 373 aa, Bacillus licheniformis
MTSNQQRVVVKVGSSSLTSLHGEISSKKLEKLVEQIVRLKDEGHEVLLVSSGAVAAGYRKLGFINRPDTLPEKQASASVGQGLLIEAYSKLFLSHGYIASQILITKSDFSDEKRYNNVRNTMNVLLKRGIIPIINENDTVTVNRLKFGDNDTLSAKVAGLIDADLLTILSDIDGLYDANPRKTPDAALVQEVTEITPEIEASAGDAGSEVGTGGMKSKLDAFKITMASGIKGFLGRADTPGILHEAICGTARGTYFIPNADSHALNHKKQWIAFNSGPEGDIVVHNESKEFIIDRKKSLYPSSIYDINGRFSNGSVVRILDQEGEEIGLGVVNFSSSQLRKWKKDTNQETAASSQAVVDREAFVCHLELSVPL

SEQ ID NO: 6243 - protein, 266 aa, Bacillus licheniformis
MAEGMISGIVQSKKLPASQIYVTNHTNHRRLEELQQKYGIQGVKKEQLDYQNIDCFILAMKPKDAEGALNSMKPHIKPHQLIVSVLAGISISFIENTLHDMQPVIRIMPNTSSAIGASATAMAEGSHVTADLSKTAKQLLQCMGEVYSIEESKMDIFTGIAGSGPAYFYYLMEHIEKAGAEAGLSQKLTREIGAQTLLGAAKMLLESPEDTAVLKDNITSPNGTTAAGLKALEESGGGEAIEQAVKQAAKRSKTISLELEQLVAAK

SEQ ID NO: 6244 - protein, 225 aa, Bacillus licheniformis
MEYVHLVVELTIGFAALFLMTKILGKTQFAQITPFDFISALILGEMVGNAIFDEDVTIWKILFAILIWAVLIYSIEVLSQKVQNIRGFLEGRPSIVINKGKIDYNALKKNKLDLNQLQTLAREKGCFSLHEIQYAILETDGSISVLPKHKYGMPTKDDLNIPYKPVQLPVPVILDGQLEKNNLHEAGFDELWLQNQLSSQGITQYQEVLYAEWRGDEGQLYITTY

SEQ ID NO: 6245 - protein, 378 aa, Bacillus licheniformis
MTITILAFIIALFFAMNIGASGAAASMGIAYGAGAVRKRQAALWISGIGVFLGAMIGGGEVVKTIGSGIIPASILNVHIVVIILGSSAISLFIANIAGIPLSTSEVTVGSIVGVGVAFQAVFTDKLLVIVMYWLIIPIAAFFLAFLIGQLLKKTEAKLRWLKQQKWARLLTALVILTGFLEAFSAGMNNVANSVGPLVGAGLLSVGSGTFLGGLFVAIGAICLGSRVIETNGKKITEFSLLQGSCVSGLGASLVIGASLFGIPVPQTQITTCSIIGIGLSEKGRAIFRKSVILKLMKVWVVSPVFSLVISYSLVKIFLDFDLYSVAVVLCVFLATLGSISLMKHARQKQSDVRRNRDHVKSIVGGRGRKREPAAWRDF

SEQ ID NO: 6246 - protein, 236 aa, Bacillus licheniformis
MNDVLTYSTWDEKASEEVMDTFSGEMDVLKWAYSTYQKIVYACSFGAEGIVLIDLISKVVKEADIVFLDTGLHFPETYELINEVKDRYPGLSIHFLKPGLSLEEQEKRYGSELWKRQPDQCCRLRKIEPLREHLSGMEAWITGLRREQSETRKHVRYINKDDNFKLIKICPLIHWTWEDVWTYIKLNQLTYHKLHDQDYPSIGCEVCTLPVTDSGNLRAGRWAHQEKTECGLHQFR

SEQ ID NO: 6247 - protein, 254 aa, Bacillus licheniformis
MISSELILPDRQLKPRKKGITILIDNGVPLSFFKDTIHGAADYIDFVKFGWGTSLITKYLEEKIDSLRQNDVQFFFGGTLFEKFLSQDKIEDYYRYCKLYGCRYVEISNGTVRLSNKDKASFISDFSKEFHVFSEVGSKDSTLSSELESAEWIDYILEDLEAGAEKVITETRESGTSGLCKSDGEMRSQLIEEILHSGIASGDLIFEAPTKQLQTCFIEKIGPDANLANIPFQDAIPLETLRLGLRSDTFYLFD

SEQ ID NO: 6248 - protein, 207 aa, Bacillus licheniformis
MGRKLKIVHAIVLGSVLQGLGMALFLFPNHIPSGGAAGIAVLLNFWFQVPHGLTVWAVNFSLLLTAVKWLEPVTVFGTMGAITMTSVSVQIFESCMPVMTTNNIWLDLFYGSVLLGAGVGLLYKYNISNGGFGALALMISIYRGGKPGTALFIMNAFIFLLTASVIAWGIVIQALICQWISTRIIDAIYQIRFRPLLMPIAGFRNKK

SEQ ID NO: 6249 - protein, 368 aa, Bacillus licheniformis
MRIEKVDTFPLFHKLSSPYGDANGLKSYRTSYLIRITTASGLTGWGECADWLPALDAGFKKRIIPYLIGKEASNRTELITVIKKWHQRAASAVSMALTDITAKKAGLSVCELWGGKLREQIPVYASFQSYSDRPDWSRHSLRLIEKAVRAGFKAVKLKAGGKMFSEDLAHIQAFQEMTGQSTGLILDANQSYDQAAARKWETWFSGWQNVLWFEEPMPFDDLAEYRMLRSALSVPVAGGENVKGAKPFLPIFLENAVDIAQPDVMHCEGTDEFQTVLKLARHFGKRVSPHSYDGGLSRIYAAFGQACLPHWTKMDGEDIEPLEWDAMENPFAQIVPVSIKDGCIQVPDKIEIDTELVEAYVWDGSSYI

SEQ ID NO: 6250 - protein, 414 aa, Bacillus licheniformis
MAEKQNSGMTVVAIGSIPLIMTLGNSMLIPILPKMKSELNLSQFQVSLVITVFSITAALFIPLLGYLADRFSRKVVIIPCLFLYGAGGILAGFASTTFANAFPWVLFGRGLQGLGAAGTAPIAMALTGDLFKGADESRVLGLVEASNGFGKVLSPILGSLIALIAWFWVFFAFPAFCIAPIILTWIFIKEKDKKKDPPPLGKYVKGLTSVFKHEGRWLFTAYLAGAVCLFTLFGILFYLSDVLEKEYHTDGVKKGLILAIPLLVMCTTSYITGSKIGQNQRLMKKMMVIGLALITVSYGTLSFFSALIPFISILVISSIGTGFVLPCVNSFITGAVGKERRGFVTSLYGSVRFLGVAIGPPIFGRLMEWSKLGMFMSIAGLTLIVGVLVLTMIHVKKEDTTKKGDKGLQPADAR

SEQ ID NO: 6251 - protein, 335 aa, Bacillus licheniformis
MNLQQPLLTIVVPCYNEEDVFAETAKQLTAVLDDLTADKLISSESKLLFVDDGSTDRTWPLIAMESTKNRYVTGLKLARNSGHQKALLAGLDKAKQKSDCVISIDADLQDDISAIRRFIEKYHEGYEIVYGVRRSRQTDTWFKRTTAGWFYKIMNKLGIQLVDNHADFRLLNKRALEELSRYAEANVFLRGLVPLIGLRSAKVYYDRKERMAGETKYPLKKMLSFAFHGITSFSVAPIRFFTLIGFFLFFLSCIAGIYAMIQKLLGYTNAGWASLIISIWFLGGLQLMGIGIIGEYIGTIFTEVKRRPRYAVDIDLYTERLGRREPEKRPETKLS

SEQ ID NO: 6252 - protein, 571 aa, Bacillus licheniformis
MDVVFVSLFVKKLSREKRYLIFAFSVILLYVLPLYILNEDAHIRVHDNLDSNIAWYKVLAESGQLLGGVKAVIPQIINGLPRDAYGTEWSGIVWLHALFPSMTAYALSQTITRVFAFVGMYLLLKSHVIRDEKAYFIRIAVSLAFALTPFWPSGMLSTLGHPLALWAFLNIRAGNDSWKEWSTLALLPLYSSFVLGFFFFLAAVSLIWLYDLVTKRSFNLRFLGSIALMTGIFLAIEYRLVYSVFASGETMHRVEFISSRHDILHSFRLSFKNFVLGHNHVMTVHTAVILPLIVLTFGLVVARQRKKRPSEEKLFIFLFILNYALSLWYALWFNKLWALPKEKISLLSAFNFARFHFLRPLVIYASFAVACYILWKMGKRWRRFVHAALIAQLLVLIPFHEELTYGAYHHAPSFREFYASDQFKQIKRFIGRPTDSYRVASIGLHPAIAQYNGFYTLDTYANIYPLKYKYQFRKIIAKELDKNPALKRYFDEWGSRCYLFVDELGKHYAFKKSTKKKITNLELNTEAFKKMGGQYIFSSVPIMNAEQNKLAFLKRFSHPQSAWNIYVYEAK

SEQ ID NO: 6253 - protein, 493 aa, Bacillus licheniformis
MGKATGFMEFKREKPAERDPLTRINDWNEYSSPFSEEASKRQGARCMDCGTPFCQIGMDIGGYTSGCPIHNLIPEWNDLVYKGRWKEALDRLLKTNNFPEFTGRVCPAPCEGSCTVAISDPAVSIKGIERTIIDKGFENGWIQPRIPKKRSGKKIAIVGSGPAGLASADQLNQAGHSVTVYERSDRPGGLLMYGIPSMKLEKSVVERRIKLLTQEGVDFVTNTEIGKDITADELKEQYDAIILCTGAQKQRDLLIEGREAKGVHFAMDYLTGTIKSMLDSNFKDKQFINTKNKDVIVIGGGDTGADCVATALRQKARSVVQFGKHPKLPDTRTAENMWPEQPHVHTLDYAYEEAQAVFGNDPRQYSIQTKKLVADKNGHLKELHTIQMKKVKNDQGKFEFHEIPGTEKVWPAQYVFIAIGFEGTEQPLLEQFGVNTVRNKVDAAYGEFKTNVDGVFAAGDARRGQSLIVWAIHEGREVAREVDKYLMGSSVLP

SEQ ID NO: 6254 - protein, 1521 aa, Bacillus licheniformis
MTYYHLPHAQGLYRPEFDHDACGICLYAHLKGLPTHDIVQKGLQMLCQLDHRGGQGSDPHTGDGAGIMMQIPDAFFKKVCADFNLPEKGRYGVGMIFFSKDDSGREKSEARINELIEQEGQTVLGWRTAPVNVGKIGTVAQESAPVVRQVFIGANEALKDNLAFERKLYIIRKQAENWAKEHEKTFYFVSLSSNTIVYKGLLTPEQVDAFYEDLQDEDFVSAFSLVHSRFSTNTFPSWERAHPNRYLIHNGEINTLRGNMNWMKAREQQFVSEAFGEDLPKVLPILDENGSDSSILDNAFEFFVLAGRKPAHAAMMLIPEPWNENPYMSKEKKAFYEYHSSLMEPWDGPTAISFTNGKQIGAILDRNGLRPARYYVTKDDYLIFSSEVGVIDVEQENILYKDRLDPGKMLLVDLEEGRIISDEEVKSEIAGEFPYQEWLSKELVHVSNDIEETEEKSVPDLLTRQKAFGFTYEDIHKYLIPVITEGKDPLGSMGHDVPLAVLSDRPQSLFNYFKQLFAQVTNPPIDAIREQIVTSTLTWLGAEGDILHPNESSCRRIKLYTPVLTNAQFNSLKGLVHKDFKSKTIHTLFTDDLKSGLEDMFKEADRAIAEGVTLLILSDRKMDGQKAPIPALLAVSALHQYLVRAGKRTKVSIIAQSGEAREVHHFAALIGYGADAIHPYLTYATYKQAIEDGALSISYEEAVTKYSKSVTEGVVKVMSKMGISTVQSYRGAQIFEAVGISKDVIDSYFTGTASQLGGIGLDTIAEEAKRRHREAYEDTFSETLDSGSDFQWRKGGEHHAFNPKTIHTLQWACRKGDYSLFKQYSKAADEERIGFLRNLFSFDENRKPLPLEEVESAESIVRRFKTGAMSFGSLSKEAHEALAIAMNRLGGKSNSGEGGEDPARFTPDANGDNRRSAIKQIASGRFGVKSHYLVNADELQIKMAQGAKPGEGGQLPGNKVYPWVANVRGSTPGVGLISPPPHHDIYSIEDLAQLIHDLKNANRDARISVKLVAKAGVGTIAAGVAKATADVIVISGYDGGTGASPKTSIKHTGLPWELGLAEAHQTLMMNGLRERVVLETDGKLMTGRDVVMAALLGAEEFGFATAPLVVLGCVMMRACHLDTCPVGVATQNPELRKKFMGDPDHIVNYMLFVAEEVRELMAQLGFRTVDEMVGRTDVLRVSERAKAHWKAGQLDLSSLLYQPEGTRTFRTPQNHKIDESLDVTQILPAVQSAVENGTPVEASFEIRNINRVTGAITGSEISKRYGEEGLPEDTITLRFTGSAGQSFGAFVPKGMTMYLTGDANDYIGKGLSGGKIAVKAPDEFNPAFRENVIVGNVAFYGATSGEAYINGLAGERFAVRNSGVSVVVEGIGDHGCEYMTGGRVAILGDVGKNFAAGMSGGIAYVYAEDKKAFKRKCNPEMIEFETLEAPEEIAELKTMIENHYKYTESSKAASILDHWEEAVGRFVKVIPKDFKQMIERIKEQKEAGLSDEEALMYAFEAGTKQKIEPSAAASSKEAVAQ

SEQ ID NO: 6255 - protein, 300 aa, Bacillus licheniformis
MELRQLHYFMEVAEREHVSEAAMHLHVAQSAISRQIANLEEELGVDLFEREGRNVKLTPIGRQFLDHIKTAMKAIDFAKEQIDEYLDPNRGTVKIGFPTSLAGQFLPTVISAFKEEHPNVAFLLRQGSYKFLIEAVKNRDIDLAFLGPVPSNIAEIKGDILFSESLLALVPVNHPLSGQKSLHLGDLRNDQYVLFPDGYILRKMAVDACKQVGYTPKISSEGEDLDAIKGLVSADMGVTLLPESAFNETAPRFTKKIPIDYPQVKRTVGIITPKNRELSPSAKVFYQFVKKFFSRLQQYQ

SEQ ID NO: 6256 - protein, 641 aa, Bacillus licheniformis
MNKHKWLAAIAIIAILAVIGYFTVRHLEPEYAYMPPKEKVISKEKRLHGYDLWGAFTPDKPASAGEGAVKVDDRLLDLGRETFYKETFGNEVFLTDIVGLLDGPITAANMTKAIAGLKGKGTTNLRIELAETVKVGGKTFKKGEKIDTGIDVAKGAYAPLGMPFKYADGKIKAGISCAACHATVDSKTMKVMEGVTNSDLNTGLMLALATNSAAYFTHAEIHNIKQFMNDKSPVITARNGKKERLPDPDRLEDAVDRIFLKWPRGFFDSTIDMKSNPTQIPDAYTLGDHPYSWSGVAMAGPFKGLTVFSNNVHAQNSDSLSQSPASRALFGMSEDVYIGTILQRAPASTYRYQPKKGESPTAFFKKADPTPGVPGVNQMVKPPSFPKITLAAPDGVHVSSPGRNVNEENNAVSAWQNTLRPPEPRQKTDGQTIRRGRRVFEQAGCISCHAGRYLTNNKVISAETIGTEPTRAQSFKKAESIFGKSLVHSPDTPVPLPRKPEVLKVPTAGFDPEQIKLSWAQGDSKGGYKVPSLIGVYWRAPYLHDGGVAVGSSLKETGIPKTIIKGKPANPYNSLLAMIDRDLRQKVIKSNSESPDLKAVRVTGKGHEFWIDAKSGFSKQEQKALIHYLIHADMPEKQEIK

SEQ ID NO: 6257 - protein, 524 aa, Bacillus licheniformis
MKKLSIVLVIFICALVSFIIWLNAGDEKLGLSDEEAEAVKPSKKPVIVLIIDSLMDQPLKKAIQEGRAPALKFFLENGHYEPEVASAYPTMSVAIDSTLLTGTYPNIHRVPGLVWYNQAGQRIVNYGSDKKEIAALGLKQTIEDGIYSLNHRHLNRKVTTVHEDLQKQGKQSASINGLIYRGPDRRELNIPPPLKKLRLMPEHMTVNGPALFSYGRFAQLDPDNSYHHIWQGYGVNDKFTAQEMAYLIKKRKLPALTVAYLPDFDHDAHKKGPKDMEGLEKMDRQLQRILNAYDSWRDAAEKAVWVVMGDGGQTSIGRDKDKAAIRLHSLFKGYRIAKINEGPDRKDQLLFAVNDRMAYIYVTDQNTPLQDAVNELKKDGRIAFTAWKKDGWIYVDSKRSLKPLRFRPQGGYQDPYGQSWTISGDFSLLDIKTDGASIMYGDYPDALARLYSAMHSHRGRFVIADAKPGFQFAGEKSPLHFGGGGHGSLYKTDSLAPMIIVGSEEVPAHLRHLELKDFLMKLVQ

SEQ ID NO: 6258 - protein, 157 aa, Bacillus licheniformis
MKQDKVGRETVEQLIEAFNRLRYAEMKQSFPSVEWKKTEAKALMFLNEANGEGKMASEISRALHVTSPFVTQLLNRMEKKGLVLRRIDEDDRRIVRIFLTDEGKKAADDALKGLNRWFLQLSRFLGEAESRHFADLIHKLSEFIEQGEKTSEKKVEK

SEQ ID NO: 6259 - protein, 575 aa, Bacillus licheniformis
MISLLKYLKPYKLQVILVAVFTLLSSVLELYLPTLMADVVDVGIVNSDMPFILKTGGWMIACSLLAIMMTVGKAFFASKTALGFGRDIRRKLFVKVEHHSMDEFGKISSASLITRTTNDVKQVQDVLNMMLSLMTRAPLMLVGGIVLAVSRDAKLSIIFLAALPILAGLIFLITRKAVPLFGVLQKKTDRLNLVLREGLTGVRVIRAFNRVDQEKVRFQKANEEFRDTGIAVNRIMAFLFPVMMIMMNFTNIAIIWFGGIRIDQGSMQVGNLMAFLQYASMILIALIMLAMTFVMIPRAQASAGRINEVLLTEPSITDPKEPQKDSGLRGYVEFQNVTFRYAGAEKPVLEDISFKAKPGETTAIIGSTGAGKTTILQLIPRFFDIEKGTVLVNGTDVRKMAQKELRAKIGYVPQKASIFSGTIKDNIRFGKEDATDEEILEALETAQAAEFVEGKENGIESEIEQAGANLSGGQKQRLSIARALVRKPEIYLFDDSFSALDYKTDQKLRKALKKTTADAAVIIVAQRVSTITDADQIIVLNEGKIAGIGTHQQLLAENGIYQEIVASQQAEEESA

SEQ ID NO: 6260 - protein, 607 aa, Bacillus licheniformis
MSQQPKHHGSIPKGMHKTKPKEFKKTLLRLARYLKPRTFQLVLVVFAAILATLFNVISPKLLGDATSSLFASFKEGTGVQFGFLGRITLILAGLYLLSALFTFLQHYLMAGVAQKTIYEMRQEVNEKLTRLPLKYYDKHSHGDTLSRAVNDIDNINTSLQQALTQMITSVITIVGIIVMMLLISPVLTLVVFITVPLSMLAVRFIASFSQKHFAAQQKELGDINGHVEEMFTGHQEVKAFGHEEKAIQQFDEVNERLYQSGWKAQFISGLMMPMMTFIGNLGYVFVSITGGIFVLNGTLLIGGVQAFIQYTQQFSQPLVQAAGIANTIQSAIASAERVFSLLDEEEETGETPASIDTGKLKGDVSFEHVAFGYDKNVPVIRDLSLHAKEGQTIAIVGPTGAGKTTIINLLMRFYELNKGSIKVGGTDISELSREQARSMFAMVLQDTWLFNGTIRENIAYGREGATEEDIIRAAKGAYADDFIRTLPDGYDTVLGEDAQNISQGQRQLLTIARAILADPKILILDEATSSVDTRTEMNIQKAMNKLMANRTSFVIAHRLSTIKDADMILVMKNGDIIEKGSHEELLRKNGFYADLYNSQFSREEAVS

SEQ ID NO: 6261 - protein, 404 aa, Bacillus licheniformis
MANSNSLQSSKHYANWIPMKEISSSNDRLFPFPIYNRIRKTSPVRYDDERKCFDIFSYEDVQFVLKNPKLFSSKRGGNMEGKSILTMDPPRHTKMRAIVNKAFTPKAVKELEPHIEEVTAFLFNEAKQKELFDVVDDLAAPLPVIIIAELLGVPAEDRLMFKHYSDILVAGAEDRSAEAAERMYKRREEGNRFLADYFKNIIKQRKKEPKDDLISLLLRAEVDGKSLTEEELLHFCIILLVAGNETTTNLIANSVRYLTEDKITQEAVRQDPSLVPVFVEEMLRYYPPVQAIGRTAAEDVDIGGVRIAKGSTVISWVASANRDELKFDDPDSFKLDRKSNPHMSFGFGIHFCLGAPLARLEAKVALDYLLRRAYMERDSSKELEAIQSPFVFGVRHLPVQLSQK

SEQ ID NO: 6262 - protein, 238 aa, Bacillus licheniformis
MQSLQNKTALITGGGRGIGRATAIALAKEGVHIGLIGRTAANLEKAAEELKAFGVKVSVAAADVKDLTAVERAVQSVKEELGQIDILINNAGIGGFAGFLEQSPEEWENIIQVNLMGVYNVTRAVLPEMIERKAGDIINISSTAGQRGAAGTSAYSASKFAVLGLTESLMQEVRKHNIRVSALTPSTVATDLAIDSKLTDGNPERVMQPEDLAEYMVAQLKLHPRIFIKSAGMWSTNP

SEQ ID NO: 6263 - protein, 866 aa, Bacillus licheniformis
MQNESFGSRFSRNGKNTASTRWGKRIAFRGIIKNQGIQVPDGFCVTTAGFQKAIKQNKSFQALLDQLTMLKVEDRDQIGEISRKIRHTIMEIEIPSNVVKEVARYLSLLGDEHAYAVRSSATAEDLPHASFAGQQDTYLNIIGKDAILQHISKCWASLFTDRAVIYRMQNGFDHRQVYSSVIIQRMVFPQASGILFTADPITSNRKLLSIDAGFGLGEALVSGLVSADCYKVQNGQIVDKRIAAKKLAIYGRKQGGTETKRITPDQQKTQALTDGQILQLAHIGRQIEAHFGQPQDIEWCLDRDTFYIVQSRPITTLYPIPEANDQENHVYLSVGHQQMMTDPIKPLGLSFYLFITPAPMRKAGGRLFVDVAPRLTTRIGRETLLNTVGSDPLIKGALMTVIERDYIKLSPNDQTAPIPDRGNTDMLAQFENDPTIVSDLIKRSETSIEELKQNIQAKSGSDLFDFILEDIRQLKKILFDPQSTAVFMAAINATSWINENMNEWLGEKNAADTLSLSVPGNITSEMGLALMDVADVIRPYPEVIDYLQHAKDDNFLDELVKVDGGQEARGAIYAYLDKYGMRCAGEIDITRARWSEKPMTLVPMILNNMKNFEPNAGNRKFEQGRRVALEKEQELIERLKPLRDGEQKAKETKRMIDLIRNFIGYREYPKYGMVSRFFIYKQALLKEADQLVQAGVIHEKEDIYYLTFEEFHEAVRTKKIDDKIISIRKDEYKLYEKLTPPRVITSDGEIITGDYKRESLPANAIVGLPVSSGVIEGRARVILNMENADLEDGDILVTSFTDPGWTPLFVSIKSLVTEVGGLMTHGAVIAREYGLPAVVGVENATQLIKDGQRIRVHGTEGYIELL

SEQ ID NO: 6264 - protein, 474 aa, Bacillus licheniformis
MEKNLNSKAILVTFMIGAFFAILNETLLNIALTELMEVFHVDAPTVQWLATGFMLVMGVLMPISALLIQWFTTRQMFIGVMSIFLAGTVIAACAVNFPMLLTGRMIQAVGTGLLIPIIMNALLLIYRPEVRGKIMGTFGLVIMFAPAIGPTFSGVIVDILGWRWLFIIVIPFAVFSILFAVKYLQNVGEPTRPRADFLSIILSTIGIGGIVYGFSSAGEAQEGFQSPLIIGVIIISLISIVLFVLRQLKLEQPLLDVRVFAYKNYTRGVCLFVIVIMAMFASEIVMPMYLQGPLGFSAKAAGLLLLPGALLNGLMSPAMGALFDKFGPRKLIIPGTIVLVGVMFFFSRINPSVPIWAFIIVYIILMLSISAIMMPAQTNALNELPKHLYPHGTAISNTLQPVAGALGVSVFVSIMSQGQKSYLAGQEAASKQIVHEAMTHGVHHAYWFALALSCIAFFTALFIKKAVAPDFDKE

SEQ ID NO: 6265 - protein, 679 aa, Bacillus licheniformis
MESYVDQKDGIFKSVCSLDCPDQCGLLVHKKDGKIVKIQGDPDHPVTQGNICNKVRNMTERIYDPKRLKTPLKRTGPKGAGMFEPISWDEAIETIRTRWQSLIEQEGPESILPYSFYGNMGNLTAEGMDRRFFHRLGSSQLDRAICTPAGSVGYKYTMGGSIGTDPEDTTETKLFIFWGINAVSTNMHQITIAQKARKNGAKIVVIDVHKNQTGRMADWFIPIRPGTDSALALGIMHVLFKEHLADESFLKEFTVGHEELRRHVRQYDPAAVEAVTGVSRNDIIELARLYGRTSPSLIRIGNGLQHHDNGGMIVRTISCLPAITGQWTKKGGGAIKGNTAFLAYNTKALQRPDLLKGRTPRVINMNQLGKALLETEPPIRSLFVYSSNPAVVAPEANKVRKGLEREDLFTVVHDLFLTETARYADIVLPASSAFENTDFYTSYWHHYAQIQKPVIEKYGESKSNTEVFRLLAEAMGFDDEPLKDSDEEMIRQALDYPDNPWLDGIDYDSLTEKHFVKANRKTVFPDKLPTPSGKIELYSKMMEQHGYPGLPTHTPLIETDKYPFLFVPGPNHNFLNSTFSNNEKHIKLEKEPKLHLNIKDAEEKGIENGDLVKVWNDRGSCILPAAVGENVLPGVAVSQGLWADAEGKHYLVNALTPDRLADMGGGATFFSGRVQIEKI

SEQ ID NO: 6266 - protein, 158 aa, Bacillus licheniformis
MSRTNHIEGKGLVNELIQQLRFHSTATVFLHQAIGEKIGLNGTDHKCLEIISREGQVTAGELAAKSGLTTGAITGVIDRLEKAGYVRRIRDSSDRRRLLVELIPENLETISHIFHDLAQESAEFLSRYSEEELQTIIKFLKNSTAFAADYAKTLKKTK

SEQ ID NO: 6267 - protein, 484 aa, Bacillus licheniformis
LRWTIPSLLRQWEQLSAILADSTALSGLYLPLWSLKWPVCRYSASCRICMAENVFFLFGSIVFMAGSALCGTATTIEQLSIYRAIQGIGGGALIPIAFTIIFDIFPLEKRGKITGLFGAVFGLSSIFGPLIGAYVTDYISWHWIFYMNLPLGMVSFIFILLFYKETKQHEKHRIDWLGAITLVGAVVCLMFALELGGGKYAWDSNVILTLFGSAAVLLVCFLMIERKASEPIISFHMFKNRLFAGSTLVALFYGGTFISATIQIPIFVQGVYGDSATNSGLVLLPMMLGSVVSAQLGGFLTTKMSYRNIMLISGLVLVSGFSLLSTLNIDTPRLLLTMYMIVVGLGVGFSFSVLSMAAIHHFGPEQRGSATSTSNFMRSLGMTIGASMFGMIQKNQFSEQLEDMFKSSGASNFASTNDADQILSSARASLPPDVLHNITEALSNSIVHTFIWAISPAAAAFLLVFFMPNDRVKVNAKKEVNKAG

SEQ ID NO: 6268 - protein, 365 aa, Bacillus licheniformis
MIRSEDKITTSQAIVVLVSYIMAAGILTLPRTAVEEAGTPDVWISVLLGGLVTTAAGVVMTKLSQHYPGQTFFQYGGDIVGKWLSIVISLLFIEHFVAIAAFEARILAEVITFFLLQQTPIWAIVMSMMWIGFYSIKDGMGSLARLFEIIFPITILFFLTVVFMSFGIFELDNLRPVLGKGIMPALKGTKATTLSFISAEVMVFLLAFMKKPKDGIKVVVMGIGIAMLFYLTTIVFVIGGLSVDGVTAMTWPALDLIRSFEMPGLIFERFESLLLVIWIMQLFATFSVSYYAASLGLSQIFKKKSRPIMFGLLPVMYLLAMTPKNIDDVFSLGDMIGYIAAVLFGIVPIPLLLVSKMRKKKAVQS

SEQ ID NO: 6269 - protein, 398 aa, Bacillus licheniformis
MKKTNTIRYLTSVLLLFLLTGCWSSHEIEELGLTFAMGIDKGEETELEKKFDKVGGDYPKKDRITMIYQYVNEQAAGSKSIGGSTDQKTYINVYETGDSLQQINAEVALRQDRPVFSPHLKVIVIAADLLRTYSLSELLDQPLRDNEIRPSSMVLVTRGRARDTLELKETGEMPAFRLLKIVENEYKAKKILPPVTLAKLTGKMRSGTSYLLQNVIGTDGEIKYAGAAAINGKTNKLIGYLDEHDLEGVMWIIGKGIGGMVKSYDPTEKKVTAFGVESIKSNIKPIVKGNRLSFEVNVKSEGYLAENWNTKEKAFDDKFLEKVEKTTAKTVKKSMEDITKKMKTEYKADLAGFGNELRIKHPRLWEKLKKNWDETFTDIPITFHVQIAIKEYGTVGDQ

SEQ ID NO: 6270 - protein, 366 aa, Bacillus licheniformis
MMVGQQDKITVSQTSIVITNFLLGTGILTLPRTSGEAVKAPDVWLSVAFGGLVAILAGFIMVKLSMEYPDKTLYQYSRDLIGKWPGGLFTLLLICYFLATSGFQVRSVTEVMGFYLLEETPIWATAMVFLWSGIYLLTGGINPLARLYEIIFPITVLIFLIVIFMSASIFDIDNLRPVLGKGIKPVLEGVKTTSFAYTGIEIILIIVPFMRKPEQALKATLMGISFPIVFYMITVIMVIGALAIEGVTSRTWPTIDLMRSFEIPGLIFERFESLLLVIWIMQMFSSFTISYFAAALGLSQLLKKRMEPILFSLLPVIYLIAMAPKNINQLFQMGDLIGNSAIYLVGLIPLMLLVISKVRRKKFEKN

SEQ ID NO: 6271 - protein, 366 aa, Bacillus licheniformis
MMVRHEERITTSQTAVLITNFLLGTGILTLPRTSVDEVGTPDVWITLVLGGLVALTAAVIMVKLNHQYPDKTFYEYSQDIIGKWGGSLISLFFACYLLAHSGFQVRSMLEIIRFFLLEGTPRWAVAMVFLWVGLYLIVGGLSSIARLFQIVLPITFILFLLVVFMSIGIFDVDNLRPVLGEGIGPVLKGIKVTALSFSGIEIILILMPFMNQPRKAIHTIMIGIAIPLLFYMITVVMVIGALSIDGVVSRTWPTIDLMRSFEIPGLIFERFESLLLVIWIMQLFCTFAIAFYGSALGLAQLFKTNIRPMMFVLLPVIYLIAMIPKNINAMFAFGDFIGNSGVYLGGLTPLVLLVISKIRRRKQGIS

SEQ ID NO: 6272 - protein, 522 aa, Bacillus licheniformis
MRWWKAKTRRMIQSSNKPDKPKNEVPSVESTGYFTGDFDHDLKLAKTAMENNSDVHFREFNLGRTGIRAAIVFVEMLADQDLIDKHIMKSLMDDFSKEYKVELSSLSSNVTDLIKKQILSISGVSEVNHVNEVVPEVLSGAAMLLIDGSAEVLLLGTVKRNTRNIEEPVSESLVRGARVGFTETIGTNTALLRQHGKNQNLSMVQFQVGKRAVKNLVVAYIKDIAEPGLVEEVKKRIEKIDIDDVLESGFVEQLIEDNYLSPFPQVQSTERLDRVMSALMEGRVAILLDGTPFVLIVPVTFSMLLQSPEDYYERWLPSSLIRIMRIGAAMISLLGPALYISFISFHPGLIPSELAISITGTRVGVPFPSLIEALIMEVAIEILREAGLRLPKPIGPAMGIVGGIIIGEAAVQAGIVSPIMVIVVAVTAISSFAIPQYSAGISLRMLRFVAMFCAATFGLYGVIMFFLMLASHAVKLKSFGVPYASPAVPYRLRDWKDFIVRMPIQMMKKRPKLLKTDDSTRQ

SEQ ID NO: 6273 - protein, 41 aa, Bacillus licheniformis
MWKTIVSYFPDWLVLMQAFFVFFVPFAISKVFLWLRTAGDE

SEQ ID NO: 6274 - protein, 575 aa, Bacillus licheniformis
MTILMKIRGLEKSFGEQTILKNIDFDISNHERIGLVGCNGAGKTTLANILSGHAEADKGTVQTDRTLKIGYLLQSIEYSVHDFNSILTGDEGGKLYQLTSSLGLSKVQSWNSERLSHLSGGEKLKLALAHVWKTMPDLLILDEPTNHLDLKGISWLLEELQQYQGAVLIISHDRYFLDQSVSKILELEDGNLHTYQGNYSAYRREKKRLYEARLHQYEVQQKQKERIESQIATLQNWSQKAHRDSTKQGSQSERRQLGFKEYHRVKAKKLDNQVKSKLKRLEQELEKNKAEKPKEAASVNFQFSSGEKRGKRIIEAKDLTKAFDGRTLFKDSHFYVKHGERIALIGDNGCGKTTLVKMMLDAEPPTAGTLWKSRSVKAAYLSQDVSDLRVDQTVAEVLNLSDRAEIANARTILANMGIKENRFHDEIGTFSLGERTRIKLAGMILKDYDLLILDEPTNHLDLPSREQLEQTLLEFQGTIIIVSHDLYFTDKLCEKLLVFENGRITRVETGLKDYRNRQKQPHAKSDEEERLRIENRMTAVLGELAGLTPQDPKYHELDQEFSELAKRKRAFLEKE

SEQ ID NO: 6275 - protein, 661 aa, Bacillus licheniformis
MKKILEWFKHPSLSKRLAVSFLLILTLPVLILSGVSYYTAGGSIEDEIMRSARNSVDQLNEMIDQNIEKKADAVTYFSEEIKEKTYKEKGQTSLRQKFEQYARQNKDVEAVFTGSEDGVYVQHPYTKMPDGYNPAERPWFKEAVEKKGEIIVTDPYTSAATGNTVITIAKQNKDGSGVAALSLNIDELIKATNDIKVGKDGFAFISSASKKYIAHPTIKAGTEGEGGWVDQVYGKGKGEFKYTFEGKAKQMAFTTNKLTGWKIAGTMFSDEITNATKPVLYMALIVFSGALVLGGVLIFFIVRAISKPLNQLVLSAKNISSGDLTQQIEVRSNDEFGQLGKSFNDMAESLRTLIGTIQESVENVASSSEQLTASAEQTSQATEHITSAIEQFSNGAESQNEKVETSSQQLSQMNDHLSEMTEVSESITEASIKSTEIAETGGELVQKTVGQMSSIDQSVKQAESVVKGLEGKSKDITSILRVINGIADQTNLLALNAAIEAARAGESGRGFSVVAEEVRKLAAQSADSAKEIEALIQEIVKEIEHSLSMFQSVNHEVQSGLKITEKTESSFHEISGMTNEIAGKLQTLNAAVEQLSNGSQEVSGAVQEIADVSRESTAGIQDIAASAEEQLASMEEISTSSATLEQMAEDLRELTKKFKVK

SEQ ID NO: 6276 - protein, 110 aa, Bacillus licheniformis
MATIEDFLKLDIRVGTVLKAEEFPEAKVPAIKLEIDFGGEIGVKCSSAQITKRYTPEKLVGRQVTAVVNFPPRRIAGFKSEVLVLGGVPEKGDVILLAPDQEAPNGTKIS

SEQ ID NO: 6277 - protein, 442 aa, Bacillus licheniformis
MFGSYMVQMVRSNAHKLDRPLRESVLKLYKPFKWTPCFLHGFFEKILMKNKKIPVIIEFEKDCQHKGYQLVNEMIGSKRRNKIKHRFSNVSCCSAEVTPSSLQSLLSECGDIRKIYLNRKVKALLDVAVESSHAKEVVRNNQTLTGKGVTVAVIDTGVYPHEDLEGRIRAFQDFINQRTEPYDDNGHGTHCAGDACGNGAASSGQYRGPAPEAELVGVKVLDKMGSGSLETVIQGVDWCIQFNKENPDDPIDIISMSLGAEALRYENEEEDPVVKAVHAAWDAGIVVCAAAGNSGPDAQTIASPGVSSKIITVGALDDRDTVSREDDDVASYSSRGPTIYGQVKPDLLVPGTNITSLRSPGSFLDKLQKTNRVGTKYMTLSGTSMATPICAGIAALILQQAPGTEPDEVKQLLMDGTDLWKDRDPNVYGAGYINAEQSVPQD

SEQ ID NO: 6278 - protein, 136 aa, Bacillus licheniformis
MGKLTEKLGLALVFSIVVWLGATVFFMLFGSAVLTEPGQDGFMLRFLLLEAGTFALLYAVMLVYRRVDKTRFAAVKLGIVGSAVGLFLDAFSLWNHSLIFPALSDGQMIGFAVWMVFAYAMYLTIPLILEKRRSAV

SEQ ID NO: 6279 - protein, 199 aa, Bacillus licheniformis
MARPNVTSKETLIEAAKRRIAEHGLDKLTLKAVAEEAKVTQGTVYYHFRTKEQLVFEVVRDLCRASWERLKANEKPAAERIKDGLSSAKSRTLKDAYYHQLFLELAVLGFRNEKIKEQLGELLEEENAVLAEQLSDLWKRSPVDGVSFSTWGILLNALIDGLALQSLMSPGFSPEKIYRELEAVLQMLTETAVKQHGGE

SEQ ID NO: 6280 - protein, 161 aa, Bacillus licheniformis
MSELTKQLIYDMYVKLLHLNEQKADTDLKAFLKQAAESDVKRLPGNMTTIHVISCIGHDEPINNTGIAKKMNLSKANITKISSKLLKEGLIKRFQLTDNKKEIYFRLTPSGKQVFELHEKLHQQKADQFSRFLDSFSTAEQGAILKFLQGLTFMTETDKKH

SEQ ID NO: 6281 - protein, 143 aa, Bacillus licheniformis
MNIEGIEMEVRCTGDVCSDALEFLRRHNHEKTAEHSIRVKQAAERLANRFHVPAQKAGIAGMMHDIRGVIPNEKRIAAAEALGIDILPEERIFPMIIHQKLSKVMARDLFQVADEDILNAIECHTTLKKILPSSTLSCFQRTK

SEQ ID NO: 6282 - protein, 161 aa, Bacillus licheniformis
MLKNVLLEQFKACYNETTWFVCFQTAAADLTESQARQKGEGSENSILEIANHLIFYNERYLKRFKGIPVPAFDYTIDDTFVNKSGLGWKESRQELNTIYAEWIDALSECEEEMLKQPAQHDPHSTWAEILSCLILHNVYHLGQIVHMRKQLKIWDASKGVN

SEQ ID NO: 6283 - protein, 548 aa, Bacillus licheniformis
MKARRFFVSVLCYAVFFIGKAPDIPAAEALLLLSMLFFVPAALDLIQHENGMFRLISVCFPYAACSASLSLLFHSPLFSLVWLCYTGMIALYGALRLWEREGRSLEEASIDSGLLYLPFGGGWLFAYTLNLQVMDFSPLIVLLTAVHFHYSAFLIPIFNGMLGRKLKKKGLLYAAVTWLIMLSPLFIAIGISFSKTIDVIAVALYLSALYGSGFLASITAFKNSAARRFVIFSSFTLMITIAFSLIYSYGVFRGRTTFTIQEMIWIHGLVNAFGVIIPALTGWRLESPGPGCERRQGETMSNIYGTWKIGADFLHRHRLQTDSSYQGLADDMSAFQSKGFQPEKVSPLILDFYEHTADYSLTAEISWRPWFKPLAHMYQLISRKTGQIHLGTKTGRQTMDGEIIGVDSARDGRKNVRAWIRTNEVGETVFVALYSAHTHDHITYMNIALPLPFSNMTGILKPKAEDGCLILTSSDKRSDRGDEGIFLSTGTGTFKLPLAERFIIKEQGRKRLCAHHRMWLFGIRFLDIQYHIEKKDSAVKRAKIANES

SEQ ID NO: 6284 - protein, 205 aa, Bacillus licheniformis
MISMYERVIEDFHLLHPKLKERYQLTQENVFKGKGVMTEISGGSYWVRLLFKAGTVFRCFFPERGRNVPFTIENHIRLTKNDTPAAVWNRTFFFQDKQRHFDAVMIYDKSRVEIIDYFGHPPILISSLRFKAEADGSLSITSVRQWLPLFRKKLPLPKCLYGISSVNESYDEEKGCFTIDVHVKNPLFGTLFAYRGTFNREEETA

SEQ ID NO: 6285 - protein, 299 aa, Bacillus licheniformis
MKKTPIYVEISIQAEMERLWRYTQDPTLHRQWDLRFTDITYLKRRPGEPQRFLYETRIGFGLKISGTGESAGNVFQDTGDRVSSLKFATNHPLSVIREGRGYWKYSESETGITFMTQYDYDTRYGRLGRLADMAFRPLLGWATAWSFDALKIWLEKGLHPRLLFQKTLVYWLVCLLFSFVWIYQGLVPKLIMAHPGEISMLSAFTGGRFHPETLLRLIGLAEVMVGVLWLYPVRKRKWFLLHIVLLVLLSASAGMADIASFAEPFNPVVLNAALIILSVIGYVSACGIPNAGNTIRKRR

SEQ ID NO: 6286 - protein, 190 aa, Bacillus licheniformis
MSPRIGLNKDAVLEAAAALADEEGIHEVTLASLSKRLNVKSPSLYNHIKGLNDLRKELALYGLTILYENMASAIQRAEEDQAVSQMAHAYLAFAKNRPGLYEATFIAMPDEDGRLDEAGDRVLALVLSVLKDYHLDDEAAIHAVRGLRSILHGFAALRQHDAFGLPYDVEESLDLTIRVFLKGIAVYQTE

SEQ ID NO: 6287 - protein, 237 aa, Bacillus licheniformis
MRMTRFESVYQLTFFPHIFPVNCYLADEEDGLTLIDTGIPISKTGILKAADHLRKPIKRILLTHAHSDHVGSLDALYHSLPGVKVSISERDARLLKGDTKMLEGERGIIKGGVPKNIKTNPDIFLKEGDRIGSLLTVSSPGHTPGSISFFDERSGLLIVGDAYHTRSGMTVSGHLKLSFPFPALATWDKEIALESAQKLLDLKPKALAAGHGDLVHDPAQAMKKAVNEAYIKLNRKG

SEQ ID NO: 6288 - protein, 157 aa, Bacillus licheniformis
MSFSHFEKQKAKLFSGVSTVTSNQNEATEKGKIPSMWSLYRERFPHKERQDMKRDTIALYSDYESEEYGAYTFSIGTFADQHEKAANVISLPASEYAVFVSRRGRIEEVVFETWQEIWTWAEKNLRTYTGDYEVYGEQAVNPENAQVAIYIAVDRKK

SEQ ID NO: 6289 - protein, 93 aa, Bacillus licheniformis
MEHYFCQSCGMPMTSELFGTEKDGGNSRDYCIYCYENGAYTHPDATLKDMIEICVPYIKEEGKTEAEARALLSRTLPYLKRWAAAQTEGGQGR

SEQ ID NO: 6290 - protein, 311 aa, Bacillus licheniformis
MKIDRLLAIVILLINKRQVQAKELAGMFEVSVRTIYRDIEAINQAGIPIVTSQGAGGGISIMERFRLENKLLSADELAAITTALESVSSTYEVLHHGSALEKIRFLVSEEEMPEFRKKTEKWFVDISSWGESPVIKEKIRLLDEASDSTRAVSFNYVDREGQTGKRKAEPHTLVLKGRHWYLYAFCLKRQAFRFFKLLRMKDVRMLEEKFERKEVDLSSLPWETSWYKPDNMTEVTLLIKPSGESLAREWFGSEALTYENGQCVATISYPEDQWLYGFLLQFGTHIEVLDPPRIRQKIKDLAKQIVHLYET

SEQ ID NO: 6291 - protein, 165 aa, Bacillus licheniformis
MQFFIIVSIVYIKFKRSVGYQPLKPARMLFRIILFSGIFVFLLTMSALHPLSYFYDLIGIALGLILTVYALKHVSIENRGGVLYFRTHLWVELIVLFLFLYRFLYRIAEIGQLQTAVSDGGSAAYGALFAQDPATMIGFFVLAVYYVGFSFFVLKKGRTEEKRSA

SEQ ID NO: 6292 - protein, 110 aa, Bacillus licheniformis
MSEHNQETTEKQVRAELDEETLFLVSQTFKALSDPTRIKILHLLSQGEHSVNEIAEKLSLLQSTVSHQLRFLKNLRLVKSRRAGTSIFYSPEDQHVLDVLQQMIDHTQHD

SEQ ID NO: 6293 - protein, 274 aa, Bacillus licheniformis
MKNHICTTCGVQYNAASKEPAECIICNEERQYVSLSGQTWTTLEEMKQSGRFQNEITFVEERLYSLTTTPEFGIGQSAYLIQEPGFNLLWDCITYLDQRTTENIEQMGGIQAIALSHPHYYSAQAEWAEMFDAPIYIHEDDKQWVQRPSSRIVFWSGETLKLSSGLTLHRLGGHFKGGAVCHWANGNAGKGILLSGDIIQVVQDRRWVSFMYSYPNLIPLPAGKVQQMADQIKDVPFNRLYNAFRRSVEKNAGECVQRSAARYVEALQGTLFST

SEQ ID NO: 6294 - protein, 80 aa, Bacillus licheniformis
MDILRGYVEAVKRNMETMNASDYDGKEEDLRRQQEELERYEQQLKEKSASAESFDQVVNAAVDCAAGDISYSQLEQMFQP

SEQ ID NO: 6295 - protein, 383 aa, Bacillus licheniformis
MKNETALKRSLTLGPLVVIGLAYMDPLVVFDSYGVVAQLTKGHVPAAYVFTVAALLLTALSYGSMVKAYPKAGSVYTYAYESIHPHAGFLAGWTIMLDYLFLPMVNFAIGSAYLTAAFPEVPHGFWVVLLALSITVVNVLGIRLTANITGLFVAFQVIVALTFAGFMIAGLAGGLGTGELISADPFFHSDIEPSLIVSGATILCFSFLGFDAISTMSEETVNPKKNIPLAIFLTVAIGGTLFTAISYLMQQIYPSYDNFRHADSASLEIALYTGGAFLKSFFLAGTMVAVISSSLSSHASASRLLYAMGRDSSLPKRFFGYVHPTLKTPVFNILFIGLISLTAMIGELEVIYSFISFGALIGLFLSICLSSAITTFGGRKKAF

SEQ ID NO: 6296 - protein, 202 aa, Bacillus licheniformis
MSFFVFVPLIIFFAISGLEQLKWLPLDTESNILERLKDYKPLVEEELDKQGLSQYTGLLLGMMYQESKGRGGDPMQSSESLGMKRNEIDDPKASIKQGVRHFTVMYQKGQKKGVDIETIIQSYNMGAGYIDYVSKHGGKHSEKLAKAFSEEQVKKNPDLYNCGGDTNNFRYPYCYGDYSYTEKVMERTKKVEEHIEGLTLEH

SEQ ID NO: 6297 - protein, 328 aa, Bacillus licheniformis
MFENKTIFITGGTGSWGQELILQLLASSPKKIIVFSRNEERQVQMRRQIEDPRLTFFIGDIRDRKALNTGLKGVDYVFHLAALKHVPVCEEQPLEALKTNVTGTENVIEAAIENGVKKVINVSTDKAADPANFYGMTKAIGEKLIVYANHLYSDTGFICVRGGNVLGSSGSVLQLFKDQIREKNQVAITDKRMTRFFLTKEKTIQLLLKAAESGQGGEIFIMNSPACKILDMAEVLIEAYGNEITSIAETGARPGEKLHELLISPHERQHAVSFTDDLAVVLPAIKMPELHKKYADCQPLETDNLSSKDFLISKEEVKEMLKKGGFLD

SEQ ID NO: 6298 - protein, 212 aa, Bacillus licheniformis
MNLKEIQGEYDAVFSLGHLCLTALQLRKMNKRPYAGPFDWVGTSSLPDLCRLIRNRFEGFMNPINLRVTGYSTGVATKDPFISVTDDYYCIDSAHDFKADRNTLDNLATYHEVIEKFNRRFNRFLEKTSTAKRVLFVRTSGTMQEAKELEEVLSDLVTNDFSVLLINHTNVSGIVENHWPLKNVCAVELPDQEIWQSNDPYWREMFQGITIR

SEQ ID NO: 6299 - protein, 137 aa, Bacillus licheniformis
MKSEIKKHLFELLTKEEIDVGWWDKYLELLFEFRKERVEALAEKAAQTNSAAGSEAVSNEQPAESGEALKNESSTNVNSKNEVLDELTASFEEMNNKIIESNNKVLEAIKESLPENYTLPNDTTLKFFQTQNETKTE

SEQ ID NO: 6300 - protein, 402 aa, Bacillus licheniformis
MKILLATYWSIPHVGGVWTYMVQLKESLESMGHEVDLLGYGEENEIVHIVNEDRKVKKEQLLPMIEQSVDQQSFPQLYDNQLVHFTEIQRYVYELAAIYLGLEKYDLIHAQDVISSGCLKRVKQKDTPLVATLHGSVAHEIRHQLTTIHRKSNSDIARAYFDHLERVGAVSADATIVANNWLKNLLTKEFDTPEEQISVLHYGYDIDSFLKRKDTKSAEIPQTDKKIILFTGRLVENKGVQHLLAALSHLKEVRDDWVCWIAGDGERMAGLRILCGQLGLENDVVFMKKRDDVPYLLSIADVYVLPSLLENQPLSVIEAQLAGLPIIVSDAGGLPEIVEHNVTGMVTPKGDAQAICNSINQLLEDETLRKTLGSNAHKFAMEYWNMDEAVNKVLDIYQQTLK

SEQ ID NO: 6301 - protein, 177 aa, Bacillus licheniformis
MTHTKKNKNYTGIVVALTIIINGVIALLFFMPKSDKFAHLDLTFLPLLNAVCNSFTFIFLVAALIMIKQKNIKAHKRFIFAAFTTTFIFLVSYLTYHSLMPDTHFGGEGIIRPIYYFILITHIVLSALIVPLALFTLFRGLSMQVERHRKIARWTMPLWLYVSLTGVLVYMMISPYY

SEQ ID NO: 6302 - protein, 326 aa, Bacillus licheniformis
MKKRIFSLLMLMSAFVLVLAACQQADPKGSYAAAYKKLISAKSYEFSSDIGLKVDASNLGAEDKQFADMLNDATLTISGKTNAETKQSEAVIKAKLKVQNMSLDFDIPVYMDEKKQVGYIKIDSVLDSFGIFLGTAGMNFDSVKGKYLEFPLEDDKSSSKDTDELQKQLMESIKEAADNLPADKFEKADLTDKEKEQGASQKVAFSFSDKEIKAAVVKFIEIAGKASGEAVPKSELNKIKDGLKDVTFKKFDVTSTIDDKENLLTENADISFSVDSKKAPQSFGITASTTYKNIDGDVKFEHKPNKEDIVTEEEFEKLMAQDAMNF

SEQ ID NO: 6303 - protein, 169 aa, Bacillus licheniformis
MITDEELQKDSSGLQKELNDLQFQLFRMRENMKDISKDSRVLGIDQSKDDEWMIVHSIDDGRTCKIMLSDCQSPYRGRCDFSLVASYTEEKRAIHIGDIKGPAGFGYGSICMKYLKEKAREHNIPVITGDIAKRDWDHVDRLIHFYEKHHFEVTIDPDSKSGEIQWQDL

SEQ ID NO: 6304 - protein, 529 aa, Bacillus licheniformis
MVWIIMTFLLINAGIFIFSYLRTKDIDLKTSDGYFLGGRSLTALYIGSSLLLTNLSTEQMVGLNGQSYSGTMSAMAWEVTAPLALIMLAFVFLPRYLSSGVTTIPDFLEKRYDQRTRQIVSILLLLGYATSFLPTVLYSGALVLDQVFNISSALGINTLVTVFLISLVIGAASCCYIFFGGLKAAASADAIYGVGLILGGLFIFVLGIMAIGDGSLLSGYTELTSVHKEKLNAITADNSAEVPWPTIFTGLLVNNLFYWAVNQSIVQRALGAKNLAEGQKGALLAGVFKTIGVFYLVLPGVIAYHLYGGHIQNADTVYPRLIVDLLPTALIGVFAAILFGAILSSFNGSLNSTITLFTLDLYKPLFKPEAKEEELVKTGRIFVVILAAVSIIIAPFILFAPSGLYNYLQEMFGFFNVPVLAAVVVGFFSKKVPALAVKWAIFAHIVLYTISKIYFGHIHFLYILAVLFPFSVLLMLFIGRLKPRPSEFKLEKNAKVDLQPWKHAKLASVLVICLMACIYLLFSPWGLAK

SEQ ID NO: 6305 - protein, 268 aa, Bacillus licheniformis
MKKTFMSFVAVAALSSTAFGASASAKEVTVQKGDTLWGISQKQGVNLQDLKEWNQLSSDLIIPGQKLNVSEKQTEEKKQYTIKKGDTLWKIAQKFGVSVNDLKNWNNIKSDIIYPNTSITVDGQATVQAAAAQPAETKPAVQKEAKVEKAAPAPAPKQEKEPASRSNVSQSTAKELTVTATAYTANDGGMTGVTATGIDLKANKNAKVIAVDPNVIPLGSKVYVEGYGEATAADTGGAIKGNKIDVFVPSKSAAKNWGVKTVKVKVLK

SEQ ID NO: 6306 - protein, 593 aa, Bacillus licheniformis
MLEKAEALLQHYFGYPSLRPGQKKAIQSVVSEKRDTACIMPTGGGKSICYQIPALLMEGTTIVISPLISLMKDQVDALNQLGIQAAYVNSSLGHNEIAERLSVFKEGGYKLFYVTPERLTSPEFIRAISHIHIPLVAIDEAHCISQWGHDFRPSYRHIEGFLNSLGTRPVVLALTATATPEVHEDICTQLGIEKENTVFTGFSRDNLTFKILKGENRDRFIESYVEKNRSEAGIIYTATRKEAERISSRLSQKGIAAGCYHGGMDDEERDRQQDLFLNDEISVMTATSAFGMGIDKSNIRYVIHAQIPKNMESYYQEAGRAGRDGLDSECILLFSPQDIRLQRFLIEQSTEDEDIRAQDVKKLRQMVDFCHTEGCLERFILSYFGEVPTEDCGRCGSCLDTRSITDVTKEAQMVLSCIIRMGERFGKTMVAQVLAGSKNKKVTENGFQQLSTYGILKKRSIADISDFIEFLIADEYIKMSDGTYPVLFVANKGRNVLLGREAVMRKEKMQTNQIVKDDELFERLRALRRKLAQEQGVPPFVVFSDETLREMSGKVPLTDEELLSVKGVGEQKRVKYGAVFLQELQAYKTEKEA

SEQ ID NO: 6307 - protein, 172 aa, Bacillus licheniformis
MDWLEFVSAMVQSLAWPAALMICVLLLKEPLSDRMKELIKLKYKDFELEFDKRLQELVSVREKRLSGLTSVRSAQRGENMIESAWSDVHNVLRETASTFDQDAIRLEGDELIQMLHDRGILQDDAAAVLSELSALRRDASDGASIAGALAYKTLCREEAERLRLLAEQQTGI

SEQ ID NO: 6308 - protein, 75 aa, Bacillus licheniformis
MSKVLTSLTDTHVKEVVMLDIAVLSMAMSQAALYQNVQMSLTKTALDTAEQSAQQLVDMVQAPHPVSGHHIDLKG

SEQ ID NO: 6309 - protein, 117 aa, Bacillus licheniformis
MLTREDIFKHVKEKFGTSPDYPFQKFPNYAALRHETTEKWYGLVMNVLPEKLGLDGNDEIDILNLKCPPEISGSLRNGKSILPGYHMDKENWISIVLERIDSEEVYNLIEQSFNLTK

SEQ ID NO: 6310 - protein, 321 aa, Bacillus licheniformis
MSTLAIIVLLGFSGYMIWKLKEAKKIHQNNLERELKNLEQTYQDHLVQAHKEASAALQQAEVMNINQKNEFLNENDFLKNKIVKMDEYINNLKKYSRNSGEVITHTILTELKEKLISEGKINENEMVIMGNVFVPYEENGETKTRQIDHLVILPSDIYIIETKYWRGTVIHGINRKNAESIANDFSFVFEQLFPKANSDTEKTIIFMKNSNIDKDSEQKNSINISYYDNPRNQVMDTMYKLRNFLITYNNKFNYVEPIVYFGYPEDKENRVIDYSTKDKNRFTSKASLCEYFKNEVLKPAKYTVDEIQQIKRIMQKVNYLS

SEQ ID NO: 6311 - protein, 30 aa, Bacillus licheniformis
LVYHPFLADTNSSNTEERVKDDIDYLVKLD

SEQ ID NO: 6312 - protein, 186 aa, Bacillus licheniformis
MARAIKRIQKIEITEEDQRKRDMKEIEDALVENKEAILEMLHMIGHMNERGVLPLLRGLFGQGDKVLDILVKKADTEETANTLKNLLLLFGTLGMLDVKQLEPLILKVNAGVANAVEQKDSEEKTGYFDIIRSLKDPEINKAVTLLFSFLKGMGQDTKELERTTQPPEHQKHHQEPREKRGMNKRD

SEQ ID NO: 6313 - protein, 764 aa, Bacillus licheniformis
MTKRCVPMIEITKGVETGYGSILAISDMESAMRDERIKKTKPVCTYCGVGCSFDVWTKGRDILKVEPQEEAPANGISTCVKGKFGWDFINSEERLTKPLIREGDHFREAEWEEALTLIASKFTDLKEEFGPDSLAFITSSKCTNEESYLMQKLARGIIGTNNVDNCSRYCQSPATAGLFRTVGYGGDSGSIADIAQADLVLIIGSNTSESHPVLSTRIKRAHKLRGQKVIVADIRKHEMAERSDLFVQPRAGSDIVWLNAIAKYLIENGKADERFLQERVNGRDEYVKSLTPYTLEYAEEKTGIDQETLIQMAEMIGQADSVCALWAMGVTQHIGGSDTSTAISNLLLVTGNYGKPGAGSYPLRGHNNVQGASDFGSMPDRLPGYEKVTDEQVRQKYEQAWGVPLPKEPGMTNHEMIEKIHSGKLKAMYVKGEEMGLVDSNINHVHAAYEKLDFFVVQDIFFSRTAEFADVVLPASPSLEKEGTFTNTERRIQRLYQVFEPLGESKPDWQIIMEVANKLGADWHYEHPADIMEEAAKLSPIYAGVTYERLEGYNSLQWPVSADGKDSPLLFTERFPFPDGKAILYPVHWTEPEEFGEEYDIHVNNGRLLEHFHEGNLTYKSKGISKKTPEVFLEISPELAAERGIQDGTLVRLTSPFGNVKVKCLITDRVKGKEVYLPMNDSGEAAINLLTGSHADKDTDTPAYKETSAKMEILKRDGSNPLPKINHRNGNPQPQIGVQVQKKWARKDYIFPGDAVKRGIGHNG

SEQ ID NO: 6314 - protein, 219 aa, Bacillus licheniformis
MEMAEQKKITINGVEMEASEEQTVLQLLNNSSIEVPQICYHPSLGPIETCDTCIVSINGELKRSCSAEVKDGDVIDTLSPDVKKAQVIGMDKILYNHELYCTVCDYNNGGCEIHNTVKEMKVNHQSIPFDQKPYHKDESNPFYRYDPDQCILCGRCVEACQDVQVTETLTIDWERKRPRVIWDNDVPINESSCVSCGHCSTVCPCNAMMEKGMREKPDI

SEQ ID NO: 6315 - protein, 84 aa, Bacillus licheniformis
MDFIYVEVLNDSNITKYISLLRKTSSKPINELKQAIETGKPVIECDYYDTEELKSLVIIIEQLLSLGASIKIYENDREITLEMS

SEQ ID NO: 6316 - protein, 221 aa, Bacillus licheniformis
MLSLGNILTIEFENEIQEYVLAKSKVLSIEDNVLRVHYPVDEETGRTVIIPTNTVAIVHFINEQQVPYKFTSVIQGREIYQDIPVLNMYLPEEDQMTKIQRRQFFRVNTTIPVTVRPYGSGSMFKTYTANISAGGAALIIEETQIHEAEEDLNLSIHLPNEGHDENVIDVYAQVKRTYIDRRTNKQIMTVEFIKMDEHDEQALVHYCIKLQLEERRKLKSD

SEQ ID NO: 6317 - protein, 60 aa, Bacillus licheniformis
MLVFFEVGEGTYLTLDLDQEEENGICPVYYFDKIIAASLEEFSRKWMKKNQTIIFMPKLT

SEQ ID NO: 6318 - protein, 92 aa, Bacillus licheniformis
MDQEIKVNTGEVKQALSKLKHSSHSMKATIPTDIKGQNHLDATKKIEELNQTINKIASSYASAFSKQVVQTESAVEAMMDTDKQLASSMKTK

SEQ ID NO: 6319 - protein, 146 aa, Bacillus licheniformis
MVITFVMHFLGSEVLQMIGSILGETLALDIMKVDLSMKKEFLAELKACRKELEKDKTEFSDSKKTITEPQLSSHTWQGSLADSFDRIRGLMKTAYNDISGKQLSDVLSKIDERIKSLQEDIHSLSQEVRSLEKKIENAKREARDKE

SEQ ID NO: 6320 - protein, 47 aa, Bacillus licheniformis
MESKMKIGLGVLIIGLGFLSHFRFSNNNDMNTASRNTTSAPSHDFIV

SEQ ID NO: 6321 - protein, 35 aa, Bacillus licheniformis
MNSGTNLFMPVYAFLFLYDEIVVFNDAYEPIAAQP

SEQ ID NO: 6322 - protein, 98 aa, Bacillus licheniformis
MINVPQKNGADRPDDYKRFSSLDKEYDSQQSLDSNAKTENVNTETDNKENTTDTTDVAGKYFDPSDYEGATQLEKGLAETHEQVSDDYFEGTIDQNLD

SEQ ID NO: 6323 - protein, 184 aa, Bacillus licheniformis
MFGADGEVKYAGAVAINGKTNKLLGFLDEKDLDGIMWIKGQGVGGTVKNYDQKTKKLTAMSVDHLKSEIKPVFKGNRLSFKVNINSEAHLAENWNTTETAIDKKYLKRKEESASQTVKQLVEQITEKMQKEYKADLAGFGDEVRIHYPFLWRKLKKNWDEVFTETPIQYDVNITIEEFGSQSRH

SEQ ID NO: 6324 - protein, 73 aa, Bacillus licheniformis
MSLSIKDFEGDWPDRTAQDVITLMPRTYRLYFENSEGECKDIRIKGTYGAIPQTYDYFSAFKKTPGRTTLFAK

SEQ ID NO: 6325 - protein, 280 aa, Bacillus licheniformis
MKNFWTYEDEDPYKLKSISERDIQKAEKKLGVKLPEEYKALILEQNGGYINFNAFPSERPTSWAKDHVQFDYLLGLGKKAGILESKYIIKEWELPDNLILIHGDGHTWIALDYRETKENPPVHYFDSEFEENYKLADSFGEFLSKLYTDNPMDDDDCQLIEGVHPDIPYVYPEDAITKEEAEQILTKNSAAELHQLNYYPIESIDDLKWLLTKMKKSALKADRDTGLALAGALEAVISYYKNLTFEDEQTRRSVRDILVILEKLNDSTVDIYLSQIDDLF

SEQ ID NO: 6326 - protein, 449 aa, Bacillus licheniformis
MQKTLFQNATIVTLDPQLHTLEKGDMLIEGSVILDVAESIEAGDAEIVDASNMLIMPGFVDTHRHVWESVIRGIGADWSLQTYLNRIYYGNYGSMRRPEDDWAANYLGALEALDAGVTTLLDWTMIESPDHTDQLIAGLKDAGIRAVFAFGTSGDAEYWDRDSDLSNMDEAKRVKKAYFQSKDQLLTMGLAIRGPEFSSWKTSVFEIETARELDALCSMHIAFGNWGAKDRSIEKLNQAGLLGPDLNMVHANAMSEEEMKMLAAHGSSISVTPEIEMMMGHGYPVTGLSLKNGVLTALGVDVVTSTGGDLFAQMKFALQAERAKHNDELLREGIMPGPELSISAEQILKAATIDGARALKLDHKIGSLSPGKEADFIMVKTDSVNLLPFTDAAGAIVQCTHTGNVDSVYVAGKAVKRNGRLVDADLEKVRQKALEARDHILFRSPEGAF

SEQ ID NO: 6327 - protein, 82 aa, Bacillus licheniformis
MYCKHHEPHVYPTKYCEDHHYSKSVVPHIHPQHTKKIDHHKYEHVHYYPHTYSHHKDVSHEHYHCGKPCKSYEKKSDYGHCY

SEQ ID NO: 6328 - protein, 260 aa, Bacillus licheniformis
MGYFIEAEPSVNLYVEDINPQSGKAIVFLHGWPLSHLQFEYQFDDLSRKGYRCIGIDWRGFGRSDKPATGYNYNRLADDIRAVVEALQLNNFTLAGHSTGGAIALRYMSRYRGAGVSKLVLIDAAAPVGFTEETAAKLLQQASNDRPKMMREVTDTFFFQYITQPFSDCFFQLGLQAAGWSTKAVIEMLRDEKLYDDPEKVAAPALIIHGIQDKVIPFAQAKELSRKIRNSYLVPFQYSGHGPFWEERKMFNRILTQFIG

SEQ ID NO: 6329 - protein, 163 aa, Bacillus licheniformis
MMALLRSLAISFVLILPAAAAYAQVPYPCSVVLDPVRDIPNARGTALIAKVKKPYTEAPGSPVRERQSVGIYADWLPDPASFGDYDQFEGIARIPDQISWRFTMHQVQEDAPSWFGGSPWAGKFDEISSELTVNTQVEVRPFNSKTKKAGEAVLRGNLQGCRS

SEQ ID NO: 6330 - protein, 78 aa, Bacillus licheniformis
MSYCKPRVLPPVVHPTRYCEDHRFSKTIVPHIHPQHIKKVDHHKYEHVHYYPHSYSSYKPVYHDHSYCGKPCDRYEKY

SEQ ID NO: 6331 - protein, 207 aa, Bacillus licheniformis
MDAISIVSFLGAAVLLTLMPGPDNLFVLAQSISKGKSAGIATASGLCTGLIVHITAAAAGISAAIYQSAVAFSIVKYAGAAYLLFLAYQSFRQKSAGFNVETKDSLNRRALYQKGVVMNLLNPKVSLFFLAFLPQFIHPGTFNVTTQMLVYGMLFLIQAFAIFVMISLFAEKVGDRLRRNPQAAKKVHLLEGSLFALIGLKIAVSQR

SEQ ID NO: 6332 - protein, 61 aa, Bacillus licheniformis
MAKTSMIVKQKREQKFKVREYTRCERCGRPHSVIRKFKLCRICFRELAYKGHIPGVKKASW

SEQ ID NO: 6333 - protein, 157 aa, Bacillus licheniformis
MSQNGIVLVASVSIFSDDKVLMIKENKPTSVNKWNFLGGRIEYGEDILYSARREVKEETGFDVNLIATTGVYNFISSTNNQVILFHFIGEVTGGSLNLEEDEISDSKWITVNDLVTFENEGLREPNVIKQITDSLLKENLHSISVYNEQLIKSFLLS

SEQ ID NO: 6334 - protein, 888 aa, Bacillus licheniformis
MEKYVLYFNEIDQFDLPSVGGKGANLGEMTKAGFPVPQGFCISTEAYRAFIQTSGIIDSLFDQLEQLKHDDLEQIRTVGKQIREHLAQISMPDEIKSAILEGIDTTGKDKAYAVRSSATAEDLPDASFAGQQDTFLNVCGKDQLLEAVKQCWSSLFTDRAISYRAKNGFDHRSVFLAVVVQEMVFPEVSGIMFTADPITGHRKTVSIDASFGLGEALVSGVVSADLYQIRSGEIVKKQLSKKESAIYSVPEGGTVQKTLSPEKQQTQALPDPRIIELAELGRKIEAHYGKEQDIEWAFAGGRFYILQSRPITSLYPVVRFFDDRPHVLINFGYIQMMTDPLKPLGVSVISQVLRFLKKDPSAQPILREAGGRVFADITGALSLKFVRSRLLKVLSGMDQLMASAVSEVVKRKEHQLYSTSTKGIFHIAGNLAPILIPAALKVAGILLMRNPDKAEKKAELIIEAIVTDTEEQLSRTSGAETIRVIQKGMGNMLQDVLSKVAVYVLSGMIAAGLLEKKLKKKLGDEKSAILLGKLYKSLPHNVTTEMGLELGDLSDQARKYPAVIDYFKRANSENFMEELLKIPGGAEMKRSLDDFLKKYGMRCVGEIDLTRPRWAEAPVQLVPSILSHIRTIAAGEHRRKFKQGETEAEEAKKEIISQFRFPEKKRVSRLVHMYRSLMGMREHHKFTLVKLMFLYKKAILKEARTLVGKGILNCEEDVFYFTLEELIALLENRGIGDIPELLTDRKRQHTSNQKLTSPRVMTSKGEIITGKLRNEKSPEGALTGTPVSAGIIEGTARVAKSPEDAKLNQGDILVAPYTDPGWTPLFTSAVGLITEVGGMMTHGSVVAREYGIPAVVGIDKATEIIEDGAYIRVDGTNGFVQILDGNGS

SEQ ID NO: 6335 - protein, 201 aa, Bacillus licheniformis
MTEQKKDRRVKRTKKMIRDALSELMKNKAFEEISVTDITKKADINRGTFYLHYEDKYDLLDQSEEEIIQEINKIAKRSIHSMDVLNQDVIDHPLTFVVDIFQYIKENEVFMKAVLGPKGPGSFRLKFKSVLISNLKRLKTAIRTDPIVPEDYLISYITGAHISVMQQWLENGMKETPHDMALILSKITGMGPAYAAGLRKK

SEQ ID NO: 6336 - protein, 41 aa, Bacillus licheniformis
MQKKGIQNSSLEQLKNDHETESAFQQDDKNNKQQQNRNALK

SEQ ID NO: 6337 - protein, 154 aa, Bacillus licheniformis
MKHVRALCLKFIVSLVLLYVVLTLFFGVPFGEMFVLTLFLGVISYLVGDLLLLPRTNNTTATMGDFGLSLVLIWVILAMQNNPPYGTLAAASIVSAIGVTVFEYFFHRYMEANVLNETENGKRENREKPGSLQYQSESSEELYPVTHSKKQDEE

SEQ ID NO: 6338 - protein, 171 aa, Bacillus licheniformis
MTHSALKHLDYHNWANQRVLTHLKSLPEELFTREIKSVFQTVSEVVTHMCVADALWLKIISGAAYEEAKETGMRLKEGLKRKKIDDFISIFHDTALQYEAFFENLEDPDGEITIAHPILGEIKTPISEILHHVVNHGTYHRGNISAMLRQMGEAGVPTDYIYYLLSLKQTT

SEQ ID NO: 6339 - protein, 208 aa, Bacillus licheniformis
MSKVLFVKANDRTAEEAVSVKLYEAFLNSYKENHPNDEIVELDLYRENPPYLGRNAINGTFKAGKGMELNEDEKAAAAVADRYLDEFVKADKVVFAFPLWNFAVPAVLHTYVDYLSRAGVTFTYTPEGPKGLMGDKKVALLNARGGFYSEGPMAAMEMSLNYMKTVMGFFGVQDLHTVVIEGHNAVPDDAQKIIENGLAEAKKLAASF

SEQ ID NO: 6340 - protein, 160 aa, Bacillus licheniformis
MPLTEEQKQHLYDKLISLKNEITGTKSEVQPMNEETGELSNGIDNHLADHAGVYTERMRDQAFRQSDDALLKEIEDALNRMKDGTYGTCETTGKEIPYERLEAIPYARRTAEAQAEARQEDRTENDRQFTRQMKDLTNKETMDQKHSYVYERLDQEQDSK

SEQ ID NO: 6341 - protein, 40 aa, Bacillus licheniformis
MFNPDSSLSLMTSSKIFDLEFTKDTDMLEIQALLSKYLCA

SEQ ID NO: 6342 - protein, 102 aa, Bacillus licheniformis
MFGKNHIRRQSALHFGEKTLQWKLYTYEKGDIHMIHEKWQNNKTIKKVKCIHTDAKKYIVNRALTVGNIYEVKNETGEFLFIIDNTNKVGGYYKEYFEEVKA

SEQ ID NO: 6343 - protein, 498 aa, Bacillus licheniformis
MTNMSSLTMQVSKKLESFLQGTKKLYINGEFVASASNKTFETPNPATGETLATLYEAGPEDVDKAVKAAREAFDRGEWRTMNPAERSRLMYKLADLMEEHKTELAQLETLDNGKPISETTAGDIPLSIEHMRYYAGWATKITGQTIPVNGPYFNYTRHEPVGVVGQIIPWNFPLLMAMWKMGAALAAGCTVVLKPAEQTPLSALYLAELIDEAGFPKGVINIIPGFGETAGEALTDHALVDKLAFTGSTEIGKKIMEKAAKSVKRVTLELGGKSPNIILPDADLKKAIPGALTGVMFNQGQVCCAGSRVFIHKDQYDKVVDEMAAYSKSLRQGAGLHEDTQMGPLVSKEQHERVLSYIEKGRQEGAKIAAGGTCPYEQGYFVSPTVFTNVEDEMTIAKEEIFGPVLAAIPYETVDEVIERANRSEYGLAAGVWTENLKNAHYIADRLQAGTVWVNCYNAFDAASPFGGYKQSGLGREMGSYALDNYTEVKSVWIHTGE

SEQ ID NO: 6344 - protein, 426 aa, Bacillus licheniformis
MTIQVDWNDRIVYSSSLGITVWKQKNFRYIWASQTAQAVGSILMTIIVMVDVFKETNSVFGSGLVLALSSFGSVLGGAIAAFAIQRLDLLQTAAWSTWFRAVCALCIGLCQSLGLPSYIIYLLLFLQSFVGSWYTPAQLGLLYQAIKKRDYVAASGSIVAVNQFVQAAGWGLGGFLTVLAQTYTLTVFTAALFFISGLLIRLPDFKKAIIPRQKARAQSVWRTVYRKKTVLLLTMMDMSEGLANAVWTSAVLLAFTKEALNKGEAWWGFINAGYFLGAILGGILAVLFSNQLKKRLGLMIFFGSVSMGITTLLFAYSSNPLLSVILCIMMGPLYQVRDVSQTVILQDTLTDEERAPVTAAKNTILAAWSIITIAIMGALADLIGVRSVFIAAAVLYAGTAAATFFVRDLRTYSQSARQQTKGKIEG

SEQ ID NO: 6345 - protein, 178 aa, Bacillus licheniformis
MFKSRKVYLRPVEKGDMESFYKAVQNEDIRYMTGTTREYTMEDLYEHYERITSDETRYDFAVCLKEDDRLIGDLSIMDIDRRNRKAGFRIALHSPAYLNKGYGIEAVRLAMQLAFERLDLNPLQLEVFSHNIRALKAYEKAGFKMEGRIREALYMNEQYSDEIIMGILKREYEELMSR

SEQ ID NO: 6346 - protein, 133 aa, Bacillus licheniformis
MNIEQMLYDTAVELIKKRYPTGWGGAAAMYTEDGRILTSVAPEVINASTELCIETGAILEAHKYQAKITHSVCVARDDEHSECKVLTPCGVCQERLFYWGPDLKAAVTVPDGRLVYKTLKEIQPYHWFAAYQK

SEQ ID NO: 6347 - protein, 629 aa, Bacillus licheniformis
MRSILEDVKAFRQKTLAELQNRQRSDGSWRFCFEGPVMTDSFFILMLTSLGDQDSSLIASLAERIRSRQSEDGAFRNHPDERAGNLTATVQGYTGMLASGLYDRKAPHMQKAEAFIKDAGGLKGVHFMTKWMLAANGLYPWPRAYIPLSFLLIPSYFPLHFYHFSTYARIHFVPMAITFNRRFSLKNNQIGSLRHLDEAMSKNPLEWLNIRAFDERTFYSFNLQWKQLFQWPAYVHQLGFEAGKKYMLDRIEEDGTLYSYASATMFMIYSLLAMGISKNAPVVKKAVSGIKSLISSCGKEGAHLENSTSTVWDTALISYAMQESGVPEQHSSTSSAADYLLKRQHVKKADWAVSNPQAVPGGWGFSHINTNNPDLDDTAAALKAIPFQRRPDAWNRGLAWLLSMQNKDGGFAAFEKDVDHPLIRNLPLESAAEAAVDPSTADLTGRVLHLLGLKGRFTDNHPAVRRALRWLDHHQKADGSWYGRWGVCFIYGTWAALTGMKAVGVSANQTSVKKAISWLKSIQREDGSWGESCKSCEAKRFVPLHFGTVVQSSWALEALLQYERPDDPQIIKGIRFLIDEHESSRERLEYPTGIGLPNQFYIRYHSYPFVFSLLASSAFIKKAEMRETY

SEQ ID NO: 6348 - protein, 281 aa, Bacillus licheniformis
MNRDAYKEKISSWAKDLKDQMKDDPSLESHLEKLFQSLDDPRATEQEWYEQAEAVYQAISRSDASQAGRQPFRTVPIGGHRLPSLPYSYSALEPYISKEIMFLHHTKHHQSYVDGLNRAEKELQKARQTKQFDLVNHWERELAFHGAGHYLHTIFWYAMHPKGKRRPTGELLEMINRSFGSYSAFKEHFSEAAKKVEGVGWAILVWAPRSHRLEILIAEKHQLMSQWDVIPLLPLDVWEHAYYLQYKNEKAKYVDNWWNVVDWREPERRFASAKRVLWEPF

SEQ ID NO: 6349 - protein, 176 aa, Bacillus licheniformis
MKKMFAFFTALMLGLTCLPYLSEAKESKHTDSSVTSLPSMSIPTSLNQSLNEEKQQFKTSAIDLSISLDLLGIGNSIRDAIVQSNNRSGFVKNCMETAFYSAGQRYNVMVFNLSQGYHNGLRGVKFYGSANYHGVIYGIWVFESGQFTNQGDGGWINWAFKGWFDRNGQTVTFRKP

SEQ ID NO: 6350 - protein, 446 aa, Bacillus licheniformis
MENKQNIWSSKLGFILASAGSAIGLGAIWKFPYVAGTSGGGAFLLMFILFTLLIGLPLLMAEFIIGRKTQKDAVESYKELAPGSLWHWVGRLGIITCFILLSFYSVVGGWIIIYIVKGLTGELSRSTDYAGLFGETIANPYLVLGSQFAFIIITILVVAKGVRSGIEKASKFMMPALFIIFLLLIVRSLTLPGSMEGLEFFLKPDLSHIKAETVLFALGQSFFSLSVGVSVMVTYSSYLSKKENLVQSAVSVTLLNVSVAILAGFAIFPAVFSFGLSPDAGPMLLFNVLPSVFHKMPLGIIFLLAFLLLFLFATLTSAFSMLEILVSSLSKGDPKKRQAFAWAGGIAIFLFGIPSALSYGVLQDVSIFNLSIFDAADYLVSNILMPLGALLIAVFVPLKIPKDELFAELKEGSKISRKWFAAWLLLIRYAAPIVIIVVFLDAIGVF

SEQ ID NO: 6351 - protein, 326 aa, Bacillus licheniformis
MSYLIKISQFAGKTFAIWVILFAILGFAFPSQFTWIVPYITILLGVIMFGMGLTLSADDFKELLRRPLHVLIGVLIQYTVMPLLAFGLAYGLALPPEIAVGVILVGCCPGGTASNVMTFLAKGNIALSVAITTLSTLLAPFLTPFLILFFAKEWLPVSPGSLFVSILQAVLLPIIAGLIVQFFFKKQVKKAVQVLPLVSVLGIVAIVSAVVGGNRENIIQSGLLIFAVVVLHNGLGLFLGFVLAKCFKMDYASQKAVSIEVGMQNSGLGAALATAHFSPLSAVPSAVFSVWHNLSGSWLATYWAKKTNKQKNDNHSPAPQMINKKL

SEQ ID NO: 6352 - protein, 426 aa, Bacillus licheniformis
MAEIKVPELAESISEGTIAQWLKQPGDYVEQGEFLLELETDKVNVELTAEQSGVLQEVLKDSGDTVQVGEIIGTISEGEGEGGKSTAPQADAQESAGASEEKAASSEKTAEPREGASDEADTAKTRTIASPAARKLAREKGIDLSEIPTGDPLGRVRKQDVESYQKNEQPPKAQPEPKRATQAPAAKQTEDAGKPVERQRMSRRRQTIAKRLVEVQHTAAMLTTFNEVDMTAVMNLRKRRKDQFLEQHDVKLGFMSFFTKAVVAALKKYPLLNAEIQGDELVIKKFYDIGIAVAAPDGLVVPVVRDADRKTFADIERDIGELAKKARNNKLSLNELQGGSFTITNGGTFGSLLSTPILNSPQVGILGMHKIQLRPVAIDEERFENRPMMYIALSYDHRIVDGKEAVGFLVTIKNLLEDPEQLLLEG

SEQ ID NO: 6353 - protein, 944 aa, Bacillus licheniformis
MFQNSMKQRMTWEEFHGPNLGYVLELYDQYVKDPESLDADLKEMFDELGAPPGDIRAASQKNEEADFTAGSIQKIASAVKLAEDIRTYGHLNASVNPLRKTQEKQELFPLAEYGLTEQDVKKIPASVICKDAPKEVTNGLEAIQYLRNTYKKSISFEFDHVHIFEERNWLMKKIESGELFTPKSKEKLVEVLRRLTEVESLEQFLHKTFVGQKRFSIEGLDALVPMLDDIIAKSVSAGTTNVNIGMAHRGRLNVLAHVLGKPYEIIFSEFQHAPNKDLVPSEGSTGINYGWTGDVKYHLGANRQIQDEHTKTARIALANNPSHLEFIDPIVEGSTRAAQETRTESGYPVQDVKKSMAILIHGDAAFPGEGIVAETLNLSQLKGYQVGGAIHIIANNMIGFTTESNESRSTKYASDLAKGFEIPIVHVNADDPEACLSAVQLAVEYRMTFNKDFLIDLIGYRRFGHNEMDEPSATQPMLYDAVRKHPTVKNIFAEKLIHKGIVDKETVGKIKDAVQKRLEEAYRKVPAKKEDMTHEIVLPEPVSNGFPDVDTSVDFETLRKINQELVSWPENFNVFDKLKRILERRAKAFEDDRKVDWSLAEAMAFASILKDGTPLRLTGQDSERGTFAHRNLVLHDSKTGDEFIALHHLADTKASFAVHNSPLSEGSVLGFEYGYNVSSPETMVIWEAQFGDFANAAQVYFDQFISAGRAKWGQKSGLVVLLPHGYEGQGPEHSSGRTERFLQLAAENNWTVANLTSAAQYFHILRRQAKMLLREEIRPLIIMTPKSLLRNPNTVSEVQELSNSSFKPVYEMSGLSHQYDKVTRLVLSSGKVSIDISDHFNKMEGEKDWLHIARVEELYPFPAKHIKAIFSKLPNLEEIVWVQEEPQNMGAWNYIEPYLREVAPKDVKVRYIGRRRRSSPAEGDPTVHKKEQERIVSDSLTRKN

SEQ ID NO: 6354 - protein, 637 aa, Bacillus licheniformis
MKFIKFNDSKIDSLLFMELTDLAKTLAKSDQVEVEYGVQSYYNPFEKKIYMSHFWKDRNHRDMVDGLKSDVYLRSIGSRYSSMKDFSRMLDSARKYQFKSLAKQLFMLFEDIRIEESIKRERPGTKQVFSNRKSMYRKHFATQLTLNLERSIFTDALFCAVYLKLTAESPLEEIPAIHESVDPMKGFIEAELARVFEARSTADIVSFVNGLMEGFEEVLEKDMLNTYFFFPELDYEQVDEEALFQDLKAKPKLSEDLTLEEKSAGDEEVHEEEMPTWHRETEAPAKSFLQFDLEHGAKSDISGGALREGEDGDQALGSVQGTAKQTKRKDYSKLESLESVQDEPNAGTAQAGKENRYAFSVMKPPEKPSNEDILDYQAQAKTIESYQKRLKQMIQKTLEHKKTLPRTDLHAGRLNNKLLRYFTERNPRLFYKKQEPSTEIDAVFTLLVDCSASMHDKMAETKRGIVLFHEALKSVAVPHQIVGFWEDTNDATETSQPNYFHTVVSFADSLKAGAGPHIMQLEPEEDNRDGYAIRQMTKMLVQRSEAQKFLIVFSDGEPAAFDYEQNGIVDTHEAVMEARKRNIEVINVFLSNSEIEESQMKTIQDMYGKYSLFVPDVDQLPDVLYPLLKKLLNKSIG

SEQ ID NO: 6355 - protein, 296 aa, Bacillus licheniformis
MKYDLHELELPEKIKERLIQSAAKPVDAEYQSLIGTPGYEAEDSAILYDAMIALSLGKNVLLKGPTGSGKTKLAETLSAYFQKPMHSVNCSVDLDAEALVGYKTIENTGGNASIEFVEGPVTKAMNNGHFLYIDEINMAKPETLPILNGVLDYRKMMTNPFTGEVVKAKEGFGVIAAINEGYVGTVPLNEALKNRFVIIDVPYIKGDLLKRVLETQSELKNQKLLDRFVTLSSDLMTQAHNGQVSEEAASIRALLDTCDLSTYIPPLRAIERGIVEKLDDEREKAAVRNIAQTLFE

SEQ ID NO: 6356 - protein, 197 aa, Bacillus licheniformis
MRTLHYILLACMSVCLAAACTQQKEIEQKNAEQEHKETFETMTQPLKVPLIKRDGTETGFIEVYESAAEGLDIRVSAHDLPPGMLAFHIHETGVCKKPDFESAGAHFNPDQKEHGFNNPKGPHAGDLPNIEVGADGKVDVIVNAPAVTLDQKSRFSLLDHDGSAFIIHEHQDDDLTNPSGNSGARMVCGALTNSGKK

SEQ ID NO: 6357 - protein, 435 aa, Bacillus licheniformis
MKKKIAAGLAASAVVGTSLAASPVEAQTIKVKSGDSLWKLSAEYNTSVSALQSANNLSSTVIYVGQTLKVPDGKSKSSSQTKSASSSSSSSAAKSTYTVKLGDSLWLIARDYKTTVQEIKNLNGLSSDMIYPGQKLVIKGSAKSAGSSSGSSSKSSGSSSGSQSASSSSSTYKVKLGDSLWKIANSLNMTVAEIKTLNNLKSDTIYPNQVLKVKGTVSSGSKPSSGSSSSSSSSKTNTGSSSKTTTYTVKPGDSLWKIANSMKVTVQSIREANQLKTDVLQVGQKLKISGASSSGSSGSPSSSSPNSSVSTGTSTSAKVERMIAEAEKHIGVPYRWGGNNPSGFDCSGFIYYTLNKVTSVSRLSAAGYWNIMSPVSQPSRGDFVFFSTYKAGPSHVGIYLGNNKFINANDSGVTVSDMNNSYWKQRYLGAKRYSF

SEQ ID NO: 6358 - protein, 452 aa, Bacillus licheniformis
MRETKDLREKARQFLTILIPILITQAGLSLITVLDTVMSGKVSAADLAGVAIGSSLWTPVYTGLAGILTAVTPMVAQLMGAKRQKDVPYTVIQSIYVAGIISLAVIVSGYFLIDPVLENLDLERKVAVIAKQYLICIGLGILPLFVYNVMRCFIDSLGKTRVTMLITLCSLPINFVLNYLFIFGNFGFPKLGGAGAGLASAITYWCICLISLYIVHKKTPFHQFRIFGTFYSFSFAESMKLLKIGIPIGFAIFFETSIFAAVTLLMSHFDTVTIASHQAAMNFASLLYMLPLSVSMTLTIVVGFEAGAKRFKDSRAYSYLGISIAVGFSLFTALIILLFREQIAGLYAADRDVLLLTKDFLLYALFFQLSDAIAAPIQGALRGYKDVNYTLVTALVSYWIIGLPVGFVIGTYTSFGAFGYWIGLITGLAAGAVGLFFRLKRIQNRYIHTQSM

SEQ ID NO: 6359 - protein, 221 aa, Bacillus licheniformis
MKKHLLVILPHPDDESFGVAGLIALNRKEDIPVTYACLTLGEMGRNMGDPLFANRETLPLLRKQELIDACREMDVQDLRMLGYRDKTLEFEDEEKLADQIEAVIDDVNPSLVVTFYPGHGVHPDHDACGAAVIRALSRKKKEDRPRVLCMAITHHREEVLGKPDVVLDIKEVADIKMNALKAHKSQTGGLLKEIEKKLANGEPVVETWFEKEAFWTYQWND

SEQ ID NO: 6360 - protein, 116 aa, Bacillus licheniformis
MKAIKKEDVQASLETFLNQPVYIHLETTTGSYSAHKDEQNMTVVAYIRNAKVACSRAKITGEGPFRAGLKTEDGWIYAEGLTDYTVDDEGRLLLAGYLPGGKLAISLQISKKPFAV

SEQ ID NO: 6361 - protein, 91 aa, Bacillus licheniformis
MADELELFQAYKTLWKNRTMEGEGREALHQAVDDELNDLGTHPRLRKTKHEKYYQSIRRIVNSQLESEMKLKLIECHTERLELLTNEESRE

SEQ ID NO: 6362 - protein, 310 aa, Bacillus licheniformis
MNHSSQTKGIIYTALSYLLWGLLPLYWKVLDQTAALDILAHRIIWSFVFMCGVLLVLRQWKNGVKAFRSLSGNRKEFVPLILSSVLISINWYVYIWAVSNGYILEASLGYYINPLVSIVLGIVFLKEKLTRMQGAAVLLAALGVLISAFQYGSVPYIALMLAFSFGLYGLAKKRTSLSSAIGLTLETMMIAPVAAIYLLFFSHPEKAQAASGSIGMMVLLFLAGVLTAIPLLLFAEGAKKLPLYQVGILQYIAPTITLCLGVFVYHEPFNSSKVFTFSCIWAALILFTLSQFQWKRPEKVFLKRKKSFHP

SEQ ID NO: 6363 - protein, 150 aa, Bacillus licheniformis
MFDWQRFFPFQQFSKDGLKNADPKDVEQYIHHMMKSVFGPGYAVQFPFRDPLSKETSAADESDPIDIFETTSHVFVKIPLTKEQLNLLKIKHTSQTLIIENYPEKGRQEKVVLPSLVRRKGTKAIFKDGILEVMFLKNEDFNLSEIDITF

SEQ ID NO: 6364 - protein, 232 aa, Bacillus licheniformis
MKKKISILITAMFLTILCFSPQASAAYNSLHTGYATYTGSGYSGGALLLDPIPSNMKITALNPTDMNYRGVKAALAGAYLRVEGPKGKTTVYVTDLYPEGAPGALDLSPNAFREIGDMKDGKIDIKWRIVKAPITGNFTYRIKEGSSQWWAAIQVRNHKYPVMKMEYYKDGKWINMEKTDYNHFVSTNLGTSPLKVRITDIRGKVVKDTIKKLPENGTSSAYTVPGKVQFPD

SEQ ID NO: 6365 - protein, 92 aa, Bacillus licheniformis
MNPHMLYSRSGPAGYPARFPLFWGFGAPLVGGLLGGFLGSAIFNYPRPYAYPPPYPGPYGGAPYYGYGAAPGAFPYGGVPGAAPYRGAGPGY

SEQ ID NO: 6366 - protein, 248 aa, Bacillus licheniformis
MNSKETVVITGGAKGIGRDLVAAYAQKGFIVVFADVLKEEGEQLEKELTASGARVQFAPCDVASEEDVKRLMQEASRNGRSISALINNAGRSVWKSPYDLTAEEWDGVLNTNLKGAFLCAREAAKRMKEAKTGGAIVNIASTRAFMSEPDSEAYAASKGGLIALTHALAASLSKDSIVVNSISPGWIETGDYTALRPIDHAQHLSNRVGRPQDIVKACFYLTDPDNRFVTGTNITVDGGMTKKMIYEE

SEQ ID NO: 6367 - protein, 106 aa, Bacillus licheniformis
MGFTMCPRMEAAFSLLGKRWNGLIIHVLLDGPKRFKDLTEMIPMISQKMLAERLKELEHCKIVERQVLPETPVKVIYQLTDKGTALEPVLKEIQTWAESHCDPEGS

SEQ ID NO: 6368 - protein, 206 aa, Bacillus licheniformis
MSSQENTALNILEERTSIKEYDTSVSISKEELTKLLSITTKAPSAWNLQHWHFTVFHSQESKDRLLPIAFNQKQVSQASAVVAVLGDLQANLNGEAVYGPLAEAGYMTEEIKNTLLGQINGAYQNSGFARDAAFTNASLAAMQLMIAAKAMGYDTCAMGGFDKEAFVKEFNIDERYVPVMLISVGKPVKPAHKSNRFDVSDVSTWL

SEQ ID NO: 6369 - protein, 201 aa, Bacillus licheniformis
MNYIYEKGDSDLTLLLLHGTGGNEHDLLPIGKMIDPDANLLGVRGNVLENGMPRFFRRLREGVFDEKDLIERTDELKTFLDEAAKELHFDRSRVVAIGYSNGANIAGSLLFRHEHVLKGAILHHPMVPFRNRKLPDMTGLPVFIGAGKTDPLCPPQESSELAGYFTNAGAKVLLHWEGGGHQLTHGEIEKAKIWYEKHIKA

SEQ ID NO: 6370 - protein, 67 aa, Bacillus licheniformis
MNQQLFKWVLFIIPFIGQLALLPFVNRIDPIVFGLPFFHFWLVLWIVLTPLITFAIYRFEKRNGGYE

SEQ ID NO: 6371 - protein, 493 aa, Bacillus licheniformis
MQGNLTALLITAGIILAVVCIGFIAGSNKQSRKSVEEWSVGGRRFGGLLVWFLVGADLYTAYTFLGLTSTAFTSGSVAFFAIPYSVLAYFIAYFFLPKIWKVAKVHQLTTLADYARERFSSKLLSSLVAIVGVLMLIPYICLQLSGIQDTLQVAGTGFINVNAVVIISFILVALYTFFSGIKGPTYTAIIKDILVWVMMLFMVVSLPLIHFNGWTPMIDKLANEAPHMLTIPSDGPRGIAWFITASIVSAFALFMWAHAATGVFTANSADALRKNSMFLPLYNIVLILVIFLGFIAFLVLPDDINPRFALLYLIQSSYGGVTQGFAYSTIALASLIPCSIMAIGASNLFANNLYRDLINPRVSGQKLTIITRSMVFVVIGLALLFGMLFPAALVTLQLLGVSGMVQIFPAIVISLFWKNQTKEATIIGLLIGLAVTFTVYLTGATFGIYEGFWGLAANLLTVVLLNPFFVKNVKHNSVINYLFHTKKNVQKSA

SEQ ID NO: 6372 - protein, 110 aa, Bacillus licheniformis; identical to SEQ ID NO: 4682

SEQ ID NO: 6373 - protein, 286 aa, Bacillus licheniformis; identical to SEQ ID NO: 4681

SEQ ID NO: 6374 - protein, 465 aa, Bacillus licheniformis
MKQQLKLFLAVLITAVAASALTLYLVGKGSGGSVYSASDSEKFEKLMAAYDKIKSDYYQNADDEKLTDGAIKGMLGALDDPYSTYMDKKEAKSFEESITSSFEGIGAQVEEKNGQILIVAPIKGSPAEKAGLKPHDEIQKVDGKSVKGKTVNEATAMIRGKKGTNVKLVLNREGVGQIDVTIKRDTIPIETVYSKMIDGNIGEIQITSFSENTAKELTKAIDDLSEKGAERFVLDLRGNPGGLMDQAIMMSNMFVDKGKTIMQVESKNGKKEVYKAEKERKVNKPTVVLVNGGTASAAEIMAAALHQSSGIPIVGENTFGKGTVQNAESFSDGSTVKLTIAKWLTPNGDWIHEKGIKPQYKAELPSYAKLPYLDSKKEYKAGSTGDEVKAAQQMLQALGYKLNATGAFDAQTEAAVKAFQKDQKLKTTGILTGETTISLTSKLQDKLSDNDTQLDKAIEILKKEK

SEQ ID NO: 6375 - protein, 236 aa, Bacillus licheniformis
MSDYLDMLASFGVSSAHPGGMSLSKAVLAKAGIDPEQPILDAGCGTGQTAAYLGQLLFPVTALDADPVMIDKARQRFKKEQLSIPAVRSPLEEMPFQSESFACVLTESVLSFTNIRSALQEIRRILKPGGMLVAIEVCLKEGNALTDEAKKEITEFYGFTALYDEDEWVNVLREEGFSKIDIIPVVLEDAGDPDDAVEMDLSPAISDKDYETMEKHLHYLEKYRDSLDHIIFISHL

SEQ ID NO: 6376 - protein, 84 aa, Bacillus licheniformis
MDRYYRFCHQNIGRVARITDKGGRVHVGRIVRVSPSKVYIAPMIRRGGRGFAYGYYGGWWGWGPVYGLGLGLIAGVALAGLFFW

SEQ ID NO: 6377 - protein, 273 aa, Bacillus licheniformis
MNGKYKYVTIASLLSAAVLLGTGCTMTEQKQNDTAKTQNTANASKDAKDQKSDSSLEDQDFILESKYFNQIKDVDGLPTIQNPENIMALVNKEYALPGNYAPSDLTVPDVAFSFTEDIDKRYIRKEAAKALEEMFSAAKKEGYELVAVSGYRSYDRQKAIYNNEVSQKGEEKAKEAVAYPGQSEHQTGLAMDISSKSNGFALSEEFGNTKDGQWVEKNAYKYGYIIRYPKNKEDITKYKYEPWHLRYVGKKAAKAIQEHDLTLEEYFKQVKKI

SEQ ID NO: 6378 - protein, 232 aa, Bacillus licheniformis
MSVHIGAEKGQIAETVLLPGDPLRAKYIADTYLENVECYNEVRGMYGFTGTYKGKRVSVQGTGMGVPSISIYVNELIRSYDVKNLIRVGSCGAIRKDVNVRDVILAMTSSTDSQINRVAFGSIDFAPCADFGLLKAAYDAASERNIPVTAGNVFTADQFYNDDSQIEKLAKHGVLAVEMETTALYTLAAKFGRKALSILTVSDHVITGEETTAEERQTTFNDMILLALDTAL

SEQ ID NO: 6379 - protein, 335 aa, Bacillus licheniformis
MFRSLNSYLIDFTGLVVISVLICLVSAGGSLASGLPFQIPASVLQLNTIFISILIEALPFVLIGVLIAGFIQIFVTEEHIRSLFPKNRFSGVIVSCLLGACFPACECGIVPIVRRLVSKGVPIYAGVGFLLTGPLINPIVVLSTYMAFGNDLRMAVLRVAVGFAAAVIIAFAISMMFRSSQLKTESRQTAAHCAHSGRRSPFSEKLFDMLKHAVDEFFDMGRFLIIGALVAALVQTYLPLKSLFVFGGGMLDSALVMMGLAYFLSLCSEADAFIGASFTNLFPSSSILAFLVYGPMLDLKNTVMMLHAFKPKFVICLSVLITVVVFVCIKVVSLL

SEQ ID NO: 6380 - protein, 290 aa, Bacillus licheniformis
MVFQLRQFLRALVLAAFSVFIFKLHYTGEIDKLINPKYDYTSLIAAGVFAFLFIIQLTRIWTVKDDRAGDCGCGHDHGESKPFFIRLMHYAVIALPLITGFTLSPAVLNSSVAANKGTMLTKTEIAPQTEGEKEHVMTPEIQQGLADSAMTKSAYDRKMDQFKQEKRIVMNDDMFADYYDEVTSNLDHYIGKEITVKGFVHKEAGLSARQLVLSRFMITHCIADASLIGFLAEWNGAEQLQPDTWIELEGTLGKASYNGSVIPIIRTKRWKEISEPEQPYVYPAAISMTD

SEQ ID NO: 6381 - protein, 44 aa, Bacillus licheniformis
MMGKKQRNRVTGLKKNNHIPTKDVIAAEDAHEKEYSARKRKNTT

SEQ ID NO: 6382 - protein, 106 aa, Bacillus licheniformis
MPLMFQLFKKKLIPYDVTIFQTPCFGEDKGYEMVYRTEINGRTHEDVLERTFSTFNVYDTVPNDYKARFLATGDIVLIDEGRKGKTYYKLLSTGWSKINRILLQSS

SEQ ID NO: 6383 - protein, 216 aa, Bacillus licheniformis
MFKNNVKEALTFLMYKALFSAAVFVIMAILIRIPAVQSFDVSVIQALESVRHPVLTAVFKALTELGSSGFMLPLMLALTLVLAVYKKAAASLYLYLLFFVERTANEALKGWIARERPAINPLVHEPSYSFPSGHSMNAASMYPFIAFLLLLCIPFFQKHSRAVYVWTGLLVGLIGISRMYLGVHYMTDVISGFSLGLALFFIFKKIGEKYPLVRQK

SEQ ID NO: 6384 - protein, 56 aa, Bacillus licheniformis
MKEIELMIDTEEIADFFYLELTRRGYIPNEDELFEIADITFDYLIAKCMIDEHIED

SEQ ID NO: 6385 - protein, 226 aa, Bacillus licheniformis
MKSNAPKFKVGDVVVVVMYGTVGTITKVHKIDKHFLYEVNHNEVLYFETSLQLYKDYDGVIVDTEKLDIEYEFLIGDVVYVKDYGKELFKITGHRTEIWRYVEDGWEDIIYELTRLKDGEWLETEEEDLTLVLRTYEMDQFVHQLLFVHYVGEAGQELDEPISEKVFLPFSGDSEEQDHERNMAVTVVDELLDIYNDYKVLYEMFQDAEYKDMMEFVLSSLKEYFK

SEQ ID NO: 6386 - protein, 73 aa, Bacillus licheniformis
MKSFYHYLMKYRHPKPKDAISEFANHAYLDHGFPKASTHYDEISSYLELNGDYLSSMTTFDEAWERYISETKR

SEQ ID NO: 6387 - protein, 93 aa, Bacillus licheniformis
MKKCEWCNEEKAAAARTAVYWELPDGTKAIEITDTPAVECEGCGMVYQEDSVTWEIENQLLLIDTKKLPSSVSYDALMKTERILKRNYFDFSS

SEQ ID NO: 6388 - protein, 469 aa, Bacillus licheniformis
MENGLFKPKRHWKDIELWKDVPEEKWNDWIWQLTNTVRTLEDLKKVVNLTKEEEEGVRISTKTIPLNITPYYASLMNPDDPRCPIRMQSVPLAEEMHKTKYDLEDPLHEDEDSPVPGLTHRYPDRVLFLVTNQCSMYCRYCTRRRFSGQIGMGVPKKQLDQAIGYIRDTPDVRDVLISGGDGLLINDQILEYILKNLRAIPHVEIIRIGTRAPVVFPQRITDKLCSILKKYHPVWLNTHFNTSIEITKEAKEACEKLVNAGVPVGNQAVILAGINDSVSIMKKLMHDLVKIRVRPYYIYQCDLSEGIGHFRAPVSKGLEIIEGLRGHTSGYAVPTFVVDAPGGGGKIAIQPNYLISQSPDKVVLRNFEGVITSYPEPENYVPGRADDYFAEIFPDVMKEKEEIGISAIYADQALSYTPDGLKRLERRESYSKRPDHETLKSRRAKRDELKEKKFLAQQKKEGEAEGHAQ

SEQ ID NO: 6389 - protein, 277 aa, Bacillus licheniformis
MVKKWSNDSCTLEADVDLFSKRIRIVNYEGNVCSFFPDILKEAKKHDIGKIIIFTKTTDRDALLERTFEPEGKIDGYFNGHDADVFVKYVKEDRRKTADWLMQDQMLAELFSTPRIAEIQNASFKIRRAVSVDAPVLADLYNSVFPVYPAPVSDSAYLKEAMGKGAVYYLAFDGEKVIASAGADVNPALGNAEITDCAVLPEYRGFSLTRRLIAELETDLKQSGIFCVFSIARAASFGMNASLYHLSYSYRGRLLNNCLIYRSIENMNIWCKNLSRS

SEQ ID NO: 6390 - protein, 422 aa, Bacillus licheniformis
MENIERKVCDWIDSHEQKAIRLLKKLVGEKSTMGREFNAQAVVLEKLRQFEAEIDVWEPSIKQLEQHPLFKSDRTSFKESPNIAAVKKGKGGGKSLILNGHIDVVPEGNRKDWETEPFQPVVKQGRIYGRGTTDMKGGNTALLIAMEALEQCGVQLKGDLIFQSVVDEECGGAGTLAAVMRGYKADGALIPEPTNMKMFIKQQGSMWFRITVKGLSAHGGTRYEGVSAIEKSMLVIQSLRQLEQVRNKRITDSLYDNIPIPVPINIGTINGGAWPSSVADTVTLEGRCGIAPNESPEAVQSELENWLNDLQYHDEWFKHYPVDIEWFGAMWLPNDLAEDHELTKVLKSAYQTITAEAPLIEASPWATDGGILSHAGGTPVIVFGPGETKMAHQANEYIEKDALIQSAKIISLFIMNWCDYER

SEQ ID NO: 6391 - protein, 217 aa, Bacillus licheniformis
MGLGVIERERIAKRAAREIKSGMIVNLGIGIPSLVPNFLDPGTSVMIQSENGLLGIGGSPEKGKEDENLCNAAGWPVTVVKGASYFDSALSFGMIRKGAIDVTILGSLQVSQSGDLANWIVPGKKVPGMGGAMELAQKAKKVIVVMSHTDKNGAPKLVADCTLPLTAKGCVDMVITEKAVITIDSGGFVLQELMNEEDLDDVLRLTEGKIRIDGPLS

SEQ ID NO: 6392 - protein, 230 aa, Bacillus licheniformis
MTMPNKRIAVEDAIADLKDEATVMFGGFGGVGSPPSFIRAILKKGVKNLTVICNDAGFPGIGIGPLIVNNRVRRLIASHIGSNPVAGKQMTDGFLAVEFSPQGTLAERIRAGGTGLGGILTDIGIDNDMVRQGKNIVSLNGRAYLAEEALSAEYAFIYGKTADEFGNIIYDKTARNMNPLMAMAADRTFAEVERIVPIGELDEEEIVTPGVFVEGVAETEGVNWKWVWES

SEQ ID NO: 6393 - protein, 446 aa, Bacillus licheniformis
MSFLIKPDLHASYPVVQYAKGSWIVDHSGKRYLDGCSGAVTCNLGHGVQEVIEPLKEQLDAVSFVYRSQFTSEPAEQLAELLAEWLPGDLNWSFFVNSGSEAVETAMKIAVQYWQEKGQNDKTIFLSRWNSYHGITNGALSLSGFYERRYRFTHMLHKYPAASAPNCYRCRLSHPECQEACVKEIELAVKRIGKQFIAGFVAEPVIGAAGAAITAPAGYYKKVKEICEDNEILFIADEVMSGIGRTGRMLAIEHWGVTPDIAVLGKGLSAGYSPIAAAVMSDGMMETVKNGSGAIMSGHTYSANPFSARAALAVLRYILKHDLVKQAEIKGEKLKRMLKEVMKQSSIIGDVRGKGLLLGIEFVADQKSKKTFPSSMPVSALVISEAKKRGLLLYPSQAGIDGGGGDAVIIAPPLTISDKEMEELIEIFKHAVYEIEKQAEKVMRER

SEQ ID NO: 6394 - protein, 411 aa, Bacillus licheniformis
MKYAWVIKGDFFRLWSGTFLSLFSSVLFYYSLVWWSLSETGSALSGSVVIGIGLTVSILVSPFTGWLSDRFHRGKLIAASDMIISAVFLMIGFLALSGMNSVFLLAASRVIVSACLTAIEPAARSLLPDTLRKEQIEKGIAFQEVLTQLIQVIVPLVTGVLFSFLHFGWLWVLCGSLSFLSIFLEWRIKDERGSQKRIPFTNKQLFSGFTSLYQNKPLKYLLYGTSIQQLVFSGFPIYIVIWTSLLLKDQAWLGGAFQSFWACGTLCAALFLSFIAKPEHAKAAVPALMLIFGLLLSPLGWIDHVVLGAVNLIVIGMISGVVNIYIEGYLQRVTEGENRGRSLGAFFAVNSSFMPLGYAAAGMLSEAVSPEYLFLIVALPAPFAAFSMMRSFYLWEKQTKETVALQDETSI

SEQ ID NO: 6395 - protein, 256 aa, Bacillus licheniformis
MTSISNTEDRYLMLTCSKKIESHYHIYTDEEIPQMFSSHFLQLQDDFPLTELYSLLVRTPEILKRNYVHVKSSYKRDLPFTMKKSLFDLGYILDEELFYSIRLADWKGDSPGVRAEWGTEKSLIDGCRMMQAYDTLSINEAFAKEKLLRKYPFYEEGIIQLCVCYSEEGEPIGCAELYLDHDENVAKIEEVAILEPYQRKGYGSGLIKQMLTAAKQSGMESCYLVTSGSDQVKTFYEKLGFQQKEKLTTIFKYLFV

SEQ ID NO: 6396 - protein, 151 aa, Bacillus licheniformis
MTNNKEERLKQLTRMQYEVTQKNGTEPPFQNEYWDLHEDGIYVDIVSGKPLFSSLDKFDAHCGWPSFTKPVDAGEIEEKLDTSHGMIRTEVRSKSADSHLGHVFPDGPGPDGLRYCINSAALRFVPKDDLEKEGYGEYVKLFERKKSGEES

SEQ ID NO: 6397 - protein, 181 aa, Bacillus licheniformis
MAEKRELATFAGGCFWCMVKPFDEQPGILKVESGYTGGHTENPTYEEVCSNTTGHREAVQITFDPRCLSYEKLLELYWQQIDPTDSGRQFTDRGESYRTAIFYHNDKQRKLAEESKKKLGESGIFKDPIATDILEAGPFYPAEEYHQDYHKKHPERYTQYRIGSGREGFLQQHWGRKHDEQ

SEQ ID NO: 6398 - protein, 144 aa, Bacillus licheniformis
MKVREQMMYDMEALLRTVFKQIRDEINELLEKEMSRNEFMILRLLSEQGPKKVTEFATILGVSASHITAVTDALVEKGWITRVRSKEDRRIIKIHLTDAGKEIIRYFEEKKTEYYFKRFSSYSDEELKTLIELFSKLDKKREQR

SEQ ID NO: 6399 - protein, 56 aa, Bacillus licheniformis
MTAPYLCPNCKTNRTRFNLIEQSPTSVKIDPATGEIVETYSDDELSPFHLPYSALP

SEQ ID NO: 6400 - protein, 362 aa, Bacillus licheniformis
MFLIDLFLNLCILITSLFIYTQLKWNIFSRKATNKQLDWIDGILGGVLGNVLMFFSIQATDETIVDLRYVPVMILFLFTGAFPAFICSLLIIGGRFVYGTNTSSIAALIGMIVIFAGYYLILRIMDKDAGTYRKTFALVIFANVAISIVILMILHDFFLMKMLLTWFWILSTIGGFTSVYIVSYLRKSHFLLKKYEEESSIDYLTGLNNVRQFDAIWNAHISNAKEKNEKLSLLLIDIDYFKTINDTYGHSNGDAILKELGTILKKSARSEDIVSRNGGEEFSVILPNCSHSQAAEIAERVRKEVETHTFFISHSKKIHITVSIGVAAFPEVIHSTGELIEKADQCLYRAKHLGRNRVCTSV

SEQ ID NO: 6401 - protein, 443 aa, Bacillus licheniformis
MKTDFTYGNVFKQLVYFSGPIILANLLQISFQFVDSLWVGNLLGAKALGAAAVSGTVFFTVLSFVLGVNNAALTILAQQKGKGDKKGLASYVNAFVVLMTAMSVLLGVIGYFFTEPLLSLLQTPGNMMDLAVSYLRIHFIGIIFLFGYNFISTVLRAVGDSQTPLRFVLLAVILNLFMDPLFISVFNLGIAGAAYATVVSQGIAFIYGVVYTVRKQLVPFSKPALPSLAETSVILKLGVPAGLQMMVISGGSMAIMSVVNSFGESVVSGFGAVQRLDSLLILPAMAIGTAVNSMAGQTFGSGDMERTKKIANYGVIYVLLFMAAVSTAIFLTGYHAVRLFISEADSAAFGEEYLKTIAFFYPFIGINFVLNGVVRAAGAMFQILVLNVISFWALRYPFTYLFSKWLGENGIALGIGMSFMLSSLTAFLYYRYGKWKHLVLFEK

SEQ ID NO: 6402 - protein, 234 aa, Bacillus licheniformis
MFSAVHNARYMAEGFQGSRYDVLPAEAPFYFRNSGKAVMIRLLHAAPHTDNLDVFVNGISVFRNVSYTDLSSYVRFPAGRIQIDVFRRGWANGPLLTVQYHLIHGRYCTVAVTGTAAKLVPVGMYDQPAADPESRSIRCVHLSPDSPALDFAVQNGPVLFSGVPFQSVTRYIPVRSQKMDVELRGAGSTAVLLKAPRITLHAGESTTLYGLGFVNGSPSLEIKAAPFPVKAPPS

SEQ ID NO: 6403 - protein, 66 aa, Bacillus licheniformis
MERIYTYFSLLSMLFSLYFGGLAAFSFVDENMDKMYLNIRYCALFLSIMIFTLDAKKHKKTDHHNQ

SEQ ID NO: 6404 - protein, 190 aa, Bacillus licheniformis
MKKWKSLFLILAAVNVMILAGIFILISLPGGQKEPPRPTPSEYQLNVTSTKDSLAAFINTYLEKESSPDLDYQIEIDDEFHIVGAIRAFSSTVDARVSFRPTVEKNGDVVLDVTRFSIGKLNVPISMVLNYMDQFYDLPDFVHVRSDAKEIQVRLSEMPLKNGMYVKAKDIDLEKDQIEFVYYKPAQTDS

SEQ ID NO: 6405 - protein, 250 aa, Bacillus licheniformis
MNIRFITVMMALVCLLSACTEWNAGVEKTSVSPKRDIVIAAVGDSLTEGVGDQEKKGYVGMVADELESRSDVKSVTVKNYAVKGSRTDQLLERLKDKEVQEGLKDADYILFTIGGNDLMKVVRQNFAHLTLTPFRAEQKLFEKRFSNILAEIREQNASAELIYVSMYNPFKFTLSELREVDQVVDEWNEGAEKRLKKVSNTKMADIADIFEEYSDEKKIAEDEFHPNQYGYSLIAKRVYEQIKNEDLPAE

SEQ ID NO: 6406 - protein, 193 aa, Bacillus licheniformis
MKNVFGIFLAGILTVFLSSCGTSKIDNPLNYDVQSFSFQNQDGKAVTLESLKGQVWVADFIFTNCETICPPMTSHMAELQKQMEEENLQARIVSFSVDPENDTPEKLKKFAANYPLSFQNWDFLTGYSQEEIEKFALKSFKSIVKKPEDEDQVIHQSSFYLVDQNGKVVKDYDGARNTPYDEIIADIKTLENR

SEQ ID NO: 6407 - protein, 280 aa, Bacillus licheniformis
MTSIKIVTDSTADLSEELLRKYHISVLPLSISIDGTVYRDRFDIQPDEFIEKMESAAELPKSSQPPLGAFIELYEELTADGSEVISIHLSSELSGTYQTAVSASNMVGGNITVIDSMYISKGLGFQVVRAALLAEEGMTAEAIVKDLENLRDRTSLYVTIDHFDNLIKGGRIGRGKALLGSLLKVKPIARLEDGIYTPEKNVRSSSQLIRYLTGQFVSAVKGRTVQAIGIAHADALDLAHRLKDSLLEHIPGIDIDIDYTTPIISVHTGKGAIGFTFYTD

SEQ ID NO: 6408 - protein, 83 aa, Bacillus licheniformis
MLLKSLEFKRSDGQKVKVTEIPLLKEDDPHFFMANLRLEIFLKTLYCSKRKKNVYSFRDYLKRALKWQDYLAIYQHDELKHNA

SEQ ID NO: 6409 - protein, 422 aa, Bacillus licheniformis
MKPLLKENSLIQVKDILKAHQNVKDVVIHTPLQKNERLSERYDCNVYLKREDLQVVRSFKLRGAYYKMKQLSKETTKNGVVCASAGNHAQGVAFSCKHLGIHGKIFMPSTTPRQKISQVELFGKEYVEIILTGDTFDDAYQSAVACCEEEKRAFIHPFDDPAVMAGQGTVAVEILNDIETEPHYLFASVGGGGLLSGVGTYMKNVSPDTKLIAVEPKGAPALFESNKKGEVVILEKIDKFVDGAAVQKIGEETFKTLETVVDDILLVPEGKVCTAILELYNQCAIVAEPAGALPIAALDLYRDEIKGKNVVCIVSGGNNDIGRMQEIKDRSMMYEGLQHYFIVNFPQRAGALREFLDEVLGPTDDITRFEYTKKNNKSSGPALVGIELKQREDYEPLIARMDRKGFRYVEVNKDEGLFHLLI

SEQ ID NO: 6410 - protein, 333 aa, Bacillus licheniformis
MIKHTYPSVGFSELIGECDSFLQTKNRAIQFAASSHPILIHGETGTGKELFAKAIHSGSSFKDDPFTHVSCSTLDEDETAEDFFLSELNEPGTLFLDEVWGLSLHLQGRLLAAIEKGMQKRLITSSSMPLIERIDSSEFRKDLYYRLNVLDLPLPSLSERRSDIPLLVHHFLKSGDHDIYVEPVVWKALEQHEFEGNVRELKNMTDYMITVSDGKTIQLYDTPPSLREQIKKKKPKDKKTASASLTLMEKEEFAFLLDAIKQLNEKGEPASRRVLSELSKSGKSELTPQQVRSRLDYLEKREFITKGRGRAGTKITLEGLRFLSSLKHHIIQD

SEQ ID NO: 6411 - protein, 213 aa, Bacillus licheniformis
MYTIKEEIANAITHGLGVLLSIPAIVFLVIFAIRYGSPVDVVSFSIFGASMLFLYLSSTLLHSIQHQKTKDILEIIDHSAIYVLIAGTYTPLLLGPLKGALGYTMLAVVWGLAIGGVVFKIFFVKRFIVVSTLVYLVMGWMAIIAIKPLYTALTGEGFALLLLGGILYSVGTIFYLWRKIPYHHAIWHTFVLGGSASMFFCVLFYVAKVPFVS

SEQ ID NO: 6412 - protein, 207 aa, Bacillus licheniformis
MLRYCFLWIYSAYMLIKHIKLLQALQTLDPRLSYANQMEAVFDKPKAFLRGCIGLTGSTVSIHQNGRSPAGPVLYVHPKLGLSELAVLLGHLDKTASFFADPRAFRYPLISGWLNKMAAVRKSADKEASLEEVEEILRKGQSFIMSEDDGLDYKSLSKRLGIPIVAVETAGTEDMKKGTLFKRLRPVDIDLTIHPAYVMTENKQLRA

SEQ ID NO: 6413 - protein, 162 aa, Bacillus licheniformis
MISLIAAMDRNRLIGKDNDLPWHLPQDLKYFKEVTKGHAVIMGRKTFESIGRPLPHRENIIVTSNKELDIPNCQVMHSAEEAVRFAKNRNEECFVIGGSTLYTEILPFADKLYVTKIDETFEGDRYFPEFSEAEWEIVSRRKGLKDDKNPYDYEFLVYQRKG

SEQ ID NO: 6414 - protein, 182 aa, Bacillus licheniformis
MKKYTMNEMVHLTKNMLNERGVAIEDIALIVQKLQEKYHPDLPLDVCIENVEKVLNKREIVHAVLTGIALDQLAEKKLLPEPLQYLVETDEPLYGIDEIIPLSIVNVYGSIGLTNFGYLDKEKFGIIKELDDCPDDEVHTFLDDIVAALAAAAASRIAHSHQDLEDEVQEERTDGQSVAKSR

SEQ ID NO: 6415 - protein, 120 aa, Bacillus licheniformis
MKMWMRKALVALFTIATFGLVSPPAALMADKPQEHQSVKESGYTAVYQKQEEPELDEDGESKSSFDTYRDELLNEAEDLSFVKFGSRISPVIEDEYREEVLPWIEEIIDIHRKTRQARDT

SEQ ID NO: 6416 - protein, 208 aa, Bacillus licheniformis
MVGKERFELYHSEGEKFFFHPNSAMFRAKRMLRGEPDPFVEAAQVEPGDKVLDCTLGLGSDAIIASLAAGEQGEVRGIEKSPLLAFLVEAGLQSWETGLDVLDQAMKRIRVHSGDSIDYLLELDDASADIVYFDPMFDDGIKESDGIAPLRKWAHSEFTLDGALHEALRVARKRVVLKDHWKSPRFEKYGFSVKKRKTALFHYGVLEK

SEQ ID NO: 6417 - protein, 144 aa, Bacillus licheniformis
MSTAYEEYMRQLVLPMRQELVQAGFKELTTAEEVETFMEDAEGTTFVVVNSVCGCAAGLARPAAVQAVSGSEKGPDETVTVFAGQDREATAKMREYFEGYEPSSPSMALLKGKEVVHFIPREQIEGREMTEIMKNITDAFEKHC

SEQ ID NO: 6418 - protein, 558 aa, Bacillus licheniformis
MTGLRSDMITKGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMIMAAMRINIPTVFVSGGPMEAGRTSDGRKISLSSVFEGVGAYQSGKIDEKGLEELEQFGCPTCGSCSGMFTANSMNCLSEALGIAMPGNGTILATSPDRREFAKQSARQLMELIKSDIKPRDIVTEKAIDNAFALDMALGGSTNTILHTLAIANEAGVDYSLERINEVAARVPHLSKLAPASDVFIEDLHEAGGVSAVLNELSKKEGALHLDTLTVTGKTLGENIAGREVKDYEVIHPIDQPFSEQGGLAVLFGNLAPDGAIIKTGGVQDGITRHEGPAVVFDSQEEALDGIINRKVKAGDVVIIRYEGPKGGPGMPEMLAPTSQIVGMGLGPKVALITDGRFSGASRGLSIGHVSPEAAEGGPLAFVENGDHIVVDIEKRILNIEISDEEWEKRKANWPGFEPKVKTGYLARYSKLVTSANTGGIMKI

SEQ ID NO: 6419 - protein, 413 aa, Bacillus licheniformis
MKIKSIEPTPSPNTMKVILTEELPGGKSNNYKKDHAEGAPPVIQEVLNIDGVKGVYHVADFIAVERNARFDWKDILPKVRAAFGMDEAEEAEGRSEEKESFGEVKVFVQMFSGIPMQVKLTDGEREERFGLPERFQEAILKLKTASSNVVLERSWKEQGVRFGDFSEIGREVTEELEAAYDEERLRKLTESAASSDAEAKRTAVQRKSYRVTLEMMDEEDWQKRYAHLEQMDPTEEDIPVLEKALNDPKTSIRRLAVVYLGMIETPAVLPLLYKALEDKTITVRRTAGDCLSDIGNPEAIPAMIKALKDPSKLVRWRAAMFLYEVGDESALPALKEAENDPEFEVSLQIKMAIERSNTVKKQKAPYEANDGKPQKRQLTKTLETASFFMLQSGDRSGNSEKSHASCNKISLFL

SEQ ID NO: 6420 - protein, 223 aa, Bacillus licheniformis
MAGLNQEQTEQIRLMSEWVKEKLSAEGTGHDWLHTERVRNVSLQIAKEEGADLFMTEACALLHDVIDEKLSDEHRVPLQELKRRLSEEWKVDPETVDGIFAIITRISFRDREKYKDELLSKEGMAVQDADRLDAIGAVGIARALMYAGAKGHLLYGGGNAPTAVGHFYEKLLLLKDLMNTKTGRMLAEKRHKLMLEFLGELENECAFSRESRLDRSGLGVMVE

SEQ ID NO: 6421 - protein, 159 aa, Bacillus licheniformis
MSIYDISVKTIKGEDTTLRPYKGKVLLIVNTASKCGFTPQYQQLQDLYETYKDRGLEILGFPSNQFMNQEPGDEKSIEEFCSVNYGVTFPMFSKVNVKGDQIHPLFRHLTNKAKGMLGTKAVKWNFTKFLVDQTGENVVRFSPQTNPKEMEETIQKWLG

SEQ ID NO: 6422 - protein, 561 aa, Bacillus licheniformis
MQMKSHLSDIEIAQRTELKPITEIARKLNINDEEIECFGCTKAKISLKIFERLKEKPDGQVILVTSINPTPAGEGKSTVTVGLSQALWQIGKKSIVAMREPSLGPTMGLKGGAAGGGYSQVLPMEDINLHFTGDMHAITAANNALAAFIDNHIHQGNELNIDIRKIVWKRALDLNDRALRETVVGLGGKANGFPREDGFDITVASEIMAVLCLARDLADLKKRLASMIVAYTVDGQPVTAGMLGVQGALALLLKDAIKPNLVQTVEGTPALVHGGPFANIAHGANSLIATKTAAKLADYVVTEAGFGADLGAEKFMHIKTRAGGFTPGAVVIVATVRALKMHGGTPLADLKQKDLEALKRGIANLAKHIETIDAFGLPYVVAVNRFVQDTEDELEAVLGWCRDNGHPAALCNVWEEGGKGGTDLAREVIHVMEQKDNRFSYLYELTDSIEDKLAKISRTVYGAEGVEFTEKAKKQLLELKKNGLDGLPVCVAKTQYSLSDDPGKIGRPQDFSITVRELKPSRGAGFIVALTGSILTMPGLPKHPAALKMDVDESGRAKGLF

SEQ ID NO: 6423 - protein, 302 aa, Bacillus licheniformis
MPINIPINLPAKQILESENIFVMDEKRAFHQDIRPLNIVILNLMPQKIKTETQLLRMLGNSPLQVYFTFLIPSTHTPKHTPRQHLEQFYTTFSSIRDRKFDGMIITGAPIEHLEYEEVSYWEELREILDWSKTHVTSTLHICWGAQAGLYHHYGIRKVKLPKKTFGVFEHRIMEKNERLVRGFEEFYYVPHSRHTDINMDDLKAVSHLKVLSISDEAGVCLIASKDEKQVFLTGHPEYDTDTLKEEYERDLARNMEIDPPVNYFKEGPDGAVPVNRWKAHATLLFMNWLNYYVYQETPYEWK

SEQ ID NO: 6424 - protein, 383 aa, Bacillus licheniformis
MNTNKNILILTANYGNGHVQVAKTLYQECERLGFKNVTVSNLYQESNPIVSEITQYLYLKSFSIGKQFYRLFYYGVDKIYNKRKFNIYFKMGNKRLDQLVKKHQPDIIINTFPMIVVPEYRRRMGKVIPTFNVMTDFCLHKIWVHEHIDKYYVATDYVKEKLLEIGTHPSNVKITGIPIRRQFEEEMDKDKIYEKYQLSPDKKILLIMAGAHGVLKNVKELCESLVTKEDVQVVVVCGKNTMLKSSLEDIEALYPNKLRTLGYIERIDELFRVADCMITKPGGITLTEATAIGVPVILYKPVPGQEKENALFFEDRGAAIVVNRHEEILESVSSLLADEKKLNEMKKNIKSLHLSNSSEVILTDIIEQSEIIMNKKQTVRALS

SEQ ID NO: 6425 - protein, 229 aa, Bacillus licheniformis
MNRYSVDEFVSKTQQEDKGEGLFEMETPRLLEVNLDGKVWAKAGSMVSYRGRVKFKREGVFEHGIGRMVKKVFSGEGAALMKAEGNGKVYLADQGKKISILNLKDDSIFVNGHDLLAFDPSIHWDIKLMKRISGMLAGGLFNIKLEGTGMAAITSHYEPLTLIVTPESPVYTDPNATVAWSGSLQPEFVTDVSFKTFIGRGSGESIQMKFSGNGFVVVQPFEEVYYSES

SEQ ID NO: 6426 - protein, 66 aa, Bacillus licheniformis
MQNGKVKWFNNEKGFGFIEVEGGDDVFVHFTAIEGEGYKSLEEGQEVSFEIVEGNRGPQASNVVKL

SEQ ID NO: 6427 - protein, 60 aa, Bacillus licheniformis
MESNELQTVLHKTFVEVYKDLEQLVDIAKKGRPSLEKNIEEIEQRLKQNILAIEIQLKIK

SEQ ID NO: 6428 - protein, 90 aa, Bacillus licheniformis
MIMKSDHRDDLETGFNQRKQLEIAVETAQKTTGMATRQKSSTLLKSAYQSIEDARQLSQAEELAALDEDFLNEQLNILNDCQHQLDESQH

SEQ ID NO: 6429 - protein, 64 aa, Bacillus licheniformis
MNVLDKKEIFKELTHLQDTYCEGCFIKKHFRKEYGKTYAHAFCISKCTVGEKLRTYGDVLTNKN

SEQ ID NO: 6430 - protein, 219 aa, Bacillus licheniformis
MKLRAGMKIKIKGSSPIQFTADEWIEVKEAVAAGRQLSQSPYVTELEFEDEKGSFWTLKELEKLKEELAAEPDEITVYFDGSYDKESQLAGLGIVIYYSLGGERYRLRKNKSFRLTTNNEAEYAALYEAVKELRDLGASRNSVVIKGDSLVVLNQLEGSWPCYDPVHSKWLDRIESQLQKLKLTPTYIQISRKDNKEADQLAKKMLEHTIVESTIKLDE

SEQ ID NO: 6431 - protein, 233 aa, Bacillus licheniformis
MFNEILWISFAIINFIIVLFFFKRFGKTGLFVWIGFATAAANIEVVKTVELFGLTATLGNILYGSVFFATDVINERYGKEEAKKAVSIGFFILITLTLVMQGALLFKPHPEDIAQPALETIFGFLPRVALGSLLAYIISQTLDVYVYSGIRRLFPSDRALWLRNSGSTALSQLLDTLIFTSVAFMGAYPLDVWIQIFITTYVLKFVVAVFAAPYAYAAKRITPLDERSENNAG

SEQ ID NO: 6432 - protein, 132 aa, Bacillus licheniformis
MPVEVYIDGASAGDPGPSGLGIFIKDGQKTESFSLPAGSLSNHEAEFMALIEGMKLCAERNYRIVSFRTDSQIVERTADSEFVKNQAFKPYLDAIIRLKKDFDLFFIKWIPSKSNQAADKLAKKAILLNQPE

SEQ ID NO: 6433 - protein, 295 aa, Bacillus licheniformis
MNKKLLLVDGMALLFRSFFATAVHRNFMLNDKGVPTNGVHGFLKHLLTAASAFEPSHVICCWDMGSKTYRNDLFKDYKANRSEPPLELIPQFDMAKEAAEELGILNIGLAGYEADDCIGTLTAMFSEEADITIVTGDKDLLQLLTVNVKVALLQKGIGNYKVYTEESFSEETGIEPKALIDIKALMGDTSDNYPGVKGIGEKTAYKLIKEYSTVDRLLENIGQLTKGQQTKITECLEDLKMSRILAEIKCDVPLSCSLDDADFTLMHDRAKEMLRLHQIRGIEPLLMKFEKREIG

SEQ ID NO: 6434 - protein, 49 aa, Bacillus licheniformis
MGRTKLGNANAQRNNNAKKKNGFNTEFATESYSQMEAAKLISSKKQHQK

SEQ ID NO: 6435 - protein, 89 aa, Bacillus licheniformis
MTNVHEAITAHSKKQHQHIKQFVRLEQEREKAIDDVVDKCRRNEAFSTDLINQITVQMNELAKKGIVPTRRLVSKEMVAEYVSRKYPQA

SEQ ID NO: 6436 - protein, 1187 aa, Bacillus licheniformis
MAQINTKDDLMKRAGAVFGELTKNGDDKRSAQLAGIIRKWLRKEVYIALTGHYSAGKSSLLNALLQEEVLPTSPIPTSANLVLVRRGEMKTTLHTVDGRYAQMDGSYDKEKVQAYCRDGSQIEMVEIGGPFSGIAPQAVLIDTPGIDSTDDAHFLSASSILHQADALFYVVHYNHVHSEENVKFLRSIKDKIPNIFFIVNQIDRHDEAETDFHAYKKQVLDMLLKEGISEEHLFFTSVTAADHPLNEFNRLRAELERLQHQSEQQLQAYTEQKISSLIHEHIKMLISDEDTALSEETASLRETVETLKSQLADLTEQEKRAEEQIKKDIQTIAQNANITPFEMRELAKSYLESIEKGFKKGILFSKAKTLEEKQKRKEAFLADVQKRVQAEIDWHVIEAIKAFMKCFNVQNDEMLREVLQFRTVIDENDLLRSRKKGAELTPEYVLNYTKELAENIRRKAKRQAQPLIDQLKTFIKERSVLQAEAIKAEYDAEQAKLAERERRLIEQQKSYEKANRLWDQWEHGNQSDLPANWYAAERKPLEKTLDAKRAEPVRAQGENSSRKDEALHPKKGVSESIEHFFELARILADIPALEKQRKAFLHKTERLHTRQFTLALFGAFSSGKSSFANALCGRKVLPSSPTPTTATINKITKPSGTKRDGTAEVAFKTEGEITAELDQLLDGKMASAKGSAFGEKLKNLLKKEELHDDERLLIKNFLKAYKRYGSYINDQEILTISADDLHPYVAEEQTACAVREVTVYLSTPVTEKGITIVDTPGASSMNKRHTELAFQYMKDADALLYLTYYQHSFSKADRSFLRRLGLIKDAFSMDKMFFILNAADLAKSPVELQTVEDYVRGELLKEGIQNPHLYHVSSKQELNKKTSPYNDFSRLKRELDDFIENGLARTAVEELLDEGKKLCETVFQLRGSLHRSAEEKEAEQKRVAKAYQEALAAIEEAEKGSSILQMTEKDVEEQFYHMKQRLAFFAHDLFKAAIHPGLQNGDWRANLQTALKSCLKEYEFEFLQELKALDIRMENLMLKFAGEQWANAVKERLAGNPYFSVHIQADRPETESWETTEASADEGEFTDELKMFKTPKTFFQQNGKARLVEAFTAKLSAITDNWIQREKQTFLNRCKTSAGQLQKAAVLSAKAQLEEQKEAYFHEALESAERENIEKAHALAGEWLRSC

SEQ ID NO: 6437 - protein, 31 aa, Bacillus licheniformis
MTMFFLLAAVSTYSLLIGYVLKGIAGANPQK

SEQ ID NO: 6438 - protein, 167 aa, Bacillus licheniformis
MFWTILSIFAAQRLLELAVAKFNEKNALKEGAVEYGKRHYPYIVAMHVSFFVSLIWETTAFQRGTLPMALVVLTGLIFTQVLRYWALFSLGKCWNTKILVIPGTNLVRKGPYQWIKHPNYLAVALEFLLLPLLFQAYATALLFTVLNAAVMYIRIRTEEQALEKLHH

SEQ ID NO: 6439 - protein, 374 aa, Bacillus licheniformis
MAYVISAGTSIPRCHVDQKEAAVFAREMFKDSFKDIDRLLSAFQNGEIASRQFVMPLDWYKEAKSFKEKNQTYIDMAVRHSAEAVSNCLSDDRFLKKEIPCGKIDAIFFISSTGISTPSIEAKLMNILPFSKRAKRIPIWGLGCAGGASGIARAFEYCKAFPKAHVLVIAAELCSLTFQKDDQSKSNLIGTSLFGDGIAALLMCGKEADFSEARFEVLPEVLGSQSSTLEDSEEVMGWEINDNGFRVVFSRDIPTLIKTHLKNDIEAFLNKEHYRFGEHSSISGPPWRKKSSRRLYGNPWIFRSAHRLFTKNFGQARQYVIGHCDACFKGILLAWRPRAGKIRSLRGARTGLFIGAAALEMDKKRVTDTCFGRF

SEQ ID NO: 6440 - protein, 183 aa, Bacillus licheniformis
METVNELVERIRTKDGGEAVIRPVKMADAPDIIEAVKDVIQTGVYIQKERPRTLEEERAFISDMMKKDNMYAAVEIDGTVYGIARVIRGELKMKRHTGLFRTWLHSKAQGLGIGREIMSYTLKWCRLHRLHKLCLTVFSENEAALSLYKKSGFIVEGVQKEQVLSDGKYEDEVLMAYFFNGST

SEQ ID NO: 6441 - protein, 438 aa, Bacillus licheniformis
MKLTAGKTVSLSIQHVLAMYAGAVVVPLIVGGALGLTPAQLTYLVSADILMCGVATLLQVWKNRFFGIGLPVVLGCTFTAVSPMISIASTYGIPAIYGSIIAGGVIVVIISFFFGKLVKFFPPVVTGSVVTVIGITLIPVAMNNMAGGEGSSDFGELSNLALAFSVLLVIVLLYRFTSGFIKSISILIGLIAGTAGAALMGKVDFTEVANAGWVQMIHPFYFGAPVFEVTPILTMSLVLIVSLVESTGVYFALGDLTDRRLTEKDLGKGYRAEGIAVLLGGVFNAFPYTAYSQNVGLVQLTGVKKNSVIALAGAFLILLGLFPKAAALTTIIPKPVLGGAMVAMFGMVIAYGIKMLSRVDFGKQENLLIVACSIGIGLGVTVVPQMFQNLPDAVKLLTENGIVAGSFTAILLNAIFHIHPFSRHAEQPEAVSAEKSAV

SEQ ID NO: 6442 - protein, 194 aa, Bacillus licheniformis
MEKLKRKIAEQGTVLSDEVLKVDSFLNHQIDPELMLAVGEEFASLFREEGVTKIVTIESSGIAPAVMAGLKLGVPVVFARKRQSLTLTENLLTASVYSFTKKTESTVAVSASHLSKDDKVLIIDDFLANGQAAKGLVSIIEQAGAKVCGIGIVIEKSFQTGREELENLGIRVESLARIASLAGGKVTFLQEVGS

SEQ ID NO: 6443 - protein, 500 aa, Bacillus licheniformis
MSINTYEKEFLETLKKISRYEQAINVMYWDMRTGAPRKGEESRAEAIGQLSADVFQMRTSPRMKELLDTLAGQKQDLPFDTQKAVEEAKKEYDLNSKIPEEEFKEYTTLTSKAESVWEKAKKASDFSLFAPYLEKIIDFKKRFISYWGYEGHPYNTLLDQYEPGVTVEKLDALFSELREAIVPLVQKIAASDKKPDTGFVHDHFPKERQRDVCHFFLQELGYDFEAGRLDETVHPFQVTISQGDARVTTAYNENDFRSAVFGTIHECGHAIYEQNIDEALGGTNLSDGASMGIHESQSLFYENFIGRHQSFWTRYFDKIKEASPDQFAGVTAEGFYRAVNESKPSLIRIEADELTYPLHIMIRYEIEKAIFSGEVSVGDLPKLWNDKYEAYLGITPPDDAKGILQDVHWSGGDFGYFPSYALGYMYAAQLKSSMLKDLPEFDRLIENGDFQPIRKWLTEHVHIHGKRKKPLEIIKSATGEELNVRHLIRYLEEKYTTLYL

SEQ ID NO: 6444 - protein, 639 aa, Bacillus licheniformis
MTASRLPFSLTKTKNFYEELNNWIGDVFYDILPEKGFDLRDEQIFMAFQLERAFKEKKVMFAEAGVGTGKTLVYLLFALSYARYTGKPAVIACADETLIEQLVKKEGDIYKISEHLGLTIDARLSKSHDQYLCLKKLEKTMQRSDDEKWLDLYESLPSFVHESQGMQAFYPYGDRKENSSLSNDEWSEIGYDSFQDCLTCDMRHRCGLTLSRDHYRKSTDFIICSHDFYMEHVWTEEARKREGQLPLLPEHSAVVFDEGHLLEFAAQKALTYRVKQSTLEMFLERLLGNDIREEFAELVEEALRANDEFFGLLTENAEKAEGSERMRIKDDTDVKKAAAELYDLLEKIGEALVFEGELYTIDQYALTVVEEYLEQMAYSLSLYRKNAISWLEQKELESTFVVMPRTVSEVLGEKVFSKQIPFIFSSATLSENGSFDYLATSLGIRDYLSFTVDSPYDYEEQMKVYIHQIEEKEAKEEAAIRAIKESGGKTLILFPSFEELLSFKRRTAQESFSFPVYFEGDEEISTIVEKFQTVEESVLCSVHLWEGLDIPGDPLQNVIIWSLPFPPHDPVFEAKRSGVENAFREVDLPYMLLRLRQGIGRLIRSNSDSGTISIFAGDEKEWNVIKEVESVLPVQPVYV

SEQ ID NO: 6445 - protein, 58 aa, Bacillus licheniformis
MLNSDHIQMIQKALETSESQLEDIGEERLTYAKEELKNAISHMESTDHPFLTHSIYRK

SEQ ID NO: 6446 - protein, 136 aa, Bacillus licheniformis
MYYYEPAKKDYWDYDYDPYKKDHDYCKKDFYYHEPCKKNYYYHEPCKKDFYYHEPCKKDYDYCKKDYDYHEDYKKDYDYHKPCKKDYDYCKKDFYYHEPCKKDYDYHKPCKKDCYYEPRKKCYDSSYKKKNDSWIY

SEQ ID NO: 6447 - protein, 383 aa, Bacillus licheniformis
MKTYTLIATAPMGIEAIVAKEVRDLGYDCTVDNGKVVFEGDALAICRANLWLRTADRVKVQAAEFIAKTFDELFEKTKAIDWSAYLPEHASFPVTGKSVKSVLASVPDCQRIVKKAIAEKLKSEYQTQGEWLEETGPEYKIEVSLLKDKAVITLDSSGAGLHKRGYRTGQGEAPLKETLAAALILLTNWTPDRPFVDPFCGSGTIPIEAALIGQNIAPGFNRDFASERWEWIGKEVWDQARLEVEEKANYDQPLSISGYDLDHRMIEIAKANAEEAGLADFIEFKQMQVKDFRTKEEYGVIVGNPPYGERLGEKKAVEAMYKDMGKAFAELDTWSVYMLTSNERFEECYGKKATKKRKLFNGFIKTDYYQYWGKRPPKPNKEK

SEQ ID NO: 6448 - protein, 98 aa, Bacillus licheniformis
MLADKVKLSAKEILEKEFKTGVRGYKQEDVDKFLDMVIKDYEAFHQEIEELQQENLQLKKQLEEANKRQPAQSNTTNFDILKRLSNLEKHVFGSKLYD

SEQ ID NO: 6449 - protein, 183 aa, Bacillus licheniformis
MKVLAVTGYKPFELGIFKHDDKALFYIKKALENRMIALLEEGLEWVLISGQLGTELWAAEVAFSLQEEFPDLKVAVITPFLEQEKKWSEKNQEQYEAVLAASDFTESLTHRPYESPVQFKQKNRFFIEKADGLLILYDEEIEGSPVYMLNEAKKAQEKRDFPIYTITMDDLRVTVEECSFYEE

SEQ ID NO: 6450 - protein, 89 aa, Bacillus licheniformis
MHCKPHVMAPIVHPTQCCYNHTHSKTVVPHIHPQHTTNVNHQHFQHVHYYPQTQSAVNKASHQHFVSPGAGMMPGPGGMPGPGMGMGPY

SEQ ID NO: 6451 - protein, 31 aa, Bacillus licheniformis
MYKGLFYLFFVVVLFIVLIMTNFKESFMAYF

SEQ ID NO: 6452 - protein, 437 aa, Bacillus licheniformis
MSLKRKLNRYKHHLGNQAKEEKTEPPADKLTSLSVSFEKEWAELGVKPYVFEECYCLIREVVYPLTHVHGHYAFSELHETVRRWNNSAVSHSLSSKGYTPSQLFFFDTETTGLGGGAGNAIFLLGHARVYDDRVVVKQHLLPKPGYEAALYHSFLSEVDIQSLVTYNGKAFDWPQVKTRHTLIRDRVPKLPDFGHFDLLHGSRRLWKHKFDRVSLGTVEKEELGVVRTEDTPGYLAPMMYFHFLKEERPEIIEGVLRHNELDVLSLITLYIHLSKKILTPEQTAEANEKYAMAKWLLANRETELATAQLQELEKKPFEHSERASFDLSMQYKKQGMLKEAAALWLKLQNGEDGKTAWRAGIELAKYFEHRKRDIRAALEVAENLLEQHGSQKFELTEKEMAGLLRRRERLERKYGRNIPRASAENDDLRKPNISSTL

SEQ ID NO: 6453 - protein, 755 aa, Bacillus licheniformis
MFQKRNLTDMIQLLKEDQAFSRQIVHWHTIEGKEADYRDFPEGLDKRIVHALQQRGIEKLYSHQADAFLHSAAGKNVTLVTPTASGKTLCYNLPVIQRITEDQDARSLYLFPTKALSQDQKSELNELIDEIGASINCYTYDGDTSPSIRQKVRKAGHIVITNPDMLHSAILPHHTKWVSLFENLKYIVIDELHVYRGVFGSHVANVIRRLMRIAEFYGSKPQFICTSATIANPLELAETLTGQPMHLISNNGAPSGRKHFLFYNPPMVNRSLNIRKSATLEVRKLASEFLKNGIQTIVFARSRVRVEIILTYLQEVMKPIVGPHSIQGYRGGYLPNERRVIEKGLRSGDIKGVVSTNALELGVDIGQLQTCIMTGYPGTISSAWQQAGRAGRRHNEALIVMVASSAPLDQYIVQNPDYFFKQNPETAVINPDNLVILVDHIKCAAFELPFKRTDTFGGIEIEDILDYLAEERVLHLTGNTYHWMNDAFPAHGISLRSASQENVVIIDQSRREKAKVIGEMDRFSAMTLLHDEAIYLHQGIQYQVEKLDWEEKKAFVREVQVDYYTDANLAVLLRVLEVDKEKKTETAAFGFGDVTVQAKATIFKKIKFETHENIGSGPIHLPEEELHTNAAWVQVNDSERQNWNDIKLEEALLGTANVLGHVAALKVMCDPSDLHVFPQIKAVHNEKPTIFLYDRYPGGVGLSQKVYEQMPEIISEAHRLISRCPCESGCPSCIGVSGGDQTKNNALRLLKGWKG

SEQ ID NO: 6454 - protein, 168 aa, Bacillus licheniformis
MLKKLFGIGQKQDEVKEETVFSPVDGQVLELSKVPDPVFSQKMMGDGMAVEPSAGEIVSPVDGEVIQLFHTKHAIGIRSLSGVELLIHIGLETVAMEGEGFTAHVKEGDKVKVGDPLITCDLELIKEKASSTITPIVIMNGDVLERVTKHEEAAAKKSETKLMELKVK

SEQ ID NO: 6455 - protein, 139 aa, Bacillus licheniformis
MDFKENDNHSLSKKDEIQEAVEQLFYNSPFHDILNSFQKLISDQLQNSTISMNIREDDGALYVDIAVPESFQNGDIMIEAKSRYLHIALKEKQESGGSSSFTSLSRTVLLPYPVREETMKTSWNRNVLTVSFSEQKKHE

SEQ ID NO: 6456 - protein, 147 aa, Bacillus licheniformis
MEERRSAVYPYSGPGAHIQAYQQNHQAYHPVQLYFSQETVPYAHPAQRPQPYQQPIEQNLDPFSVYHQPVQQQMQPLPPFQGFPYQHPYPSPRPNLHQPSQFQSFLSQFKKKNGQIDFSKMMDTAGQMVSTVNQVGALAKGFMGFFK

SEQ ID NO: 6457 - protein, 115 aa, Bacillus licheniformis
MYDIEAFLVPKVLSQVCQKVSKILIFEKQKKVELLWYYIINIKGEGMHHMNVSYLRNCFAEMKQYETDCMNKLMDFAKFLYIQGHLTLNEFRTSMKVLEANGAQHPAYDMNTDAS

SEQ ID NO: 6458 - protein, 126 aa, Bacillus licheniformis
MKKLDTQSLLIQTQDLIRLVKEAEERYRKGKEEGTEYDFFEVVKPSVERFEQTVKSWLAESLSYIKANRPKYIYEEQLNSVEENANEIFMQSYFCKIHKKRFKDLTESVLYTLKNVEDDILKEDRA

SEQ ID NO: 6459 - protein, 132 aa, Bacillus licheniformis
MQKSADHTIFRKITCRKRRVWLENEFLWRFASSFVSCGGESAHKGECIEGHQKGGKQMNGFASKDSVLQMLLETESDMSSAEKALTEAVRRTEQEKQSAWNERLDLIEKELAELSSCLNSTLMGVEPGVETA

SEQ ID NO: 6460 - protein, 34 aa, Bacillus licheniformis
MENNKKKSPAKTKPDAKQTDTLDKKLGGPNRPST

SEQ ID NO: 6461 - protein, 319 aa, Bacillus licheniformis
MHNTFSAAELTSRIQELTAKLNKDNISRTNAYKRYFDRHPEIKWSLLASFVSRNAGWSMTDLKGRLFELGLTAFQQKWLFLAYERANWLIFSDAYPQLLLYHWSKQLGQPLFHLLSSFGVSSFMKTEWERFWHERDQKRLMYALIINEQNTIQTPIIQNPLFKKNVFQTIPFQLCEWFHFNTVIFPTVEGVFYGVSVKRFTSLKERIKLGKQLSELLFSPELFPGFFHFTSCVPHTGSRFDMERWAGVKIRTSPFLRTCYPVVAHSLDGLKCDWFRGGKREAMFKDEKLPKTIEITDWYFQKRRQLQALFSLEHWLNKR

SEQ ID NO: 6462 - protein, 198 aa, Bacillus licheniformis
MIRYPNGKSYQPKTAASSLQKKPSYSNRGMTLEDDLNETNMYYQSHSIAVIHKKPTPVQIVQVDYPKRSAAVIKEAYFKQSSTTDYNGVYKGRYIDFEAKETKSRTSFPLQNFHDHQIEHMKQVVAQDGICFVIISAFEEIYFLEAEKLFYFWERKKQNGRKSIRKDELQEAAHPISLGYSPRIDYIKIIDQLYFSPS

SEQ ID NO: 6463 - protein, 895 aa, Bacillus licheniformis
MSDQFNSRQERRKAQQGKSRSNTHSKPKKKKKAGLFKKILLSILIIGVIGLIAGGVTFAVMVADSPSLDEAKLKTPYSSTIYDKNGKEIAEIGSEKRTYVSIKDIPDSVKNAFLATEDARFYDHHGVDPIRIGGALLANFEGGFGSEGGSTITQQVVKNSLLSHEKTLKRKVQEVWLSFQLERKYSKDEILEMYLNRIYFSPQAYGVGKAAEQFYGVTDLNDLTVEQAATLAGMPQSPNNYNPIKHPEKAEKRRNVVLSLMNKHGFISDAEYNKAKKVAVTKGLVSPKEYAKTTSNKYSAFIEQAVAEVKEKANVTPGTDGLKIYTTIDTDAQDYVDELMDGDSIQYTEKMQAGLTLLDTKTGEIRALGGGRDRKAGDFNYAVDTKRQPGSTIKPILDYGPVIENKKWSTYEQIKDEAYTYSTGDPINNYDRSYRGWISMREALVDSRNIPALKAFQAAGKDNIVKFAGNLGLNINSDDLVEAYAIGGFGNGVSPLQMAGAYSAFGNNGYYNEPHTVTAVEFNDGTKLDLTPESKAAMSDYTAFMITDMLKSAVQRGTGTAAQVPGVTVAGKTGTTNFTEDDIRKHGINRNGARDSWFVGYTPQYTAAVWTGKEGFNSLSQSEQQVAKLLFKKLIAKVDNGSGSFEKPDSVVEATVLKGSNPPVLASSNTPSDKKVTEYFVKGTQPTTVSKKYEEKENADKPSGLSAEYDEASKSIKLSWSYSGDGDVSFKVKQSVDGGGYSEIQNSSAKEAVIPNAKEGSVYRFQVTAVTEDGESDPASVTLKVNAADEDESKTDDEKKDDDEKKQDADDDQDKDKQNNGNSNQPNDQNPGNSDQNNQNPGNSDQNNGRKDDDADDQDNDQNKDKDKDKNKNPDQGANTGDQQTNSNGQSTGTN

SEQ ID NO: 6464 - protein, 167 aa, Bacillus licheniformis
MTSVSLLDEYEKTLRKKRPESGERLAVLSENPLCYDFFQDAGEDKPWEHAEEWVPLLFAEWERTKEKLLPVFKTRKSRCSQDDMLNGVCCLIASLHWTMGEPVKSLNWEIITRKDFGAKPMNWTERLEFILLKPTQYHCFIQLDELFTEMKKQFYKYVAMNHKKATH

SEQ ID NO: 6465 - protein, 220 aa, Bacillus licheniformis
MLTKKQIEFCLDTIGEMFPDAECELVHDNPFELVIAVALSAQCTDALVNKVTKTLFQKYKKPEDYLAVPLEELQQDIKSIGLYRNKAKNIQKLCKMLLEDYGGEVPRDRDELVKLPGVGRKTANVVVSVAFGVPAIAVDTHVERVSKRLGICRWKDSVMEVEKTLMKKVPESEWSVTHHRLIFFGRYHCKAQRPKCEECPLFSLCREGQKRYKKGLVKLL

SEQ ID NO: 6466 - protein, 232 aa, Bacillus licheniformis
MKKQHFIKMQDMGAVTIPNLLFMNYRELGLNETEFMLLLNIKMHVERGSFFPTPEELSKTMSIETEECMNMLRMFIQKGFIYIEECEDQNGIKFEKYSLEPLWGKLFELLEMAEQKKLAEQNEGEQKSLYTIFEEEFARPLSPLECETLSIWLDQDHHDAQLIKQALKEAVISGKLNFRYIDRILFEWKKNGVSTVEQAVNYSQRFRRKTAPRQNEQKEYTRQVPFYNWLEQ

SEQ ID NO: 6467 - protein, 430 aa, Bacillus licheniformis
MKTTINQVYKHVGEEVTIGAWIANKRSSGKIAFLQLRDGTGFIQGVVVKAEVDEETFQTAKSVTQETSLYVKGVVKEDERSPLGYELAVTSLEVIHEATDYPITPKEHGTEFLMDHRHLWLRSKRQHATMKIRNEIIRATYEFFNKEGFVKVDPPILTGSAPEGTTELFATKYFDEDAYLSQSGQLYMEAAAMALGKVFSFGPTFRAEKSKTKRHLIEFWMIEPEMAFVEFNENLEVQENYVSFIVQSVLENCKIELNTLGRDTSKLELIKAPFPRITYDEAIQFLKEKGFDDIEWGDDFGAPHETAIAESYDKPVFITHYPTSLKPFYMQPAPDREDVVLCADLIAPEGYGEIIGGSERIHDLELLEARLKEHGLESDAYQWYAELRKYGSVPHSGFGLGLERTVAWICGSPHVRETIPFPRLLNRLYP

SEQ ID NO: 6468 - protein, 394 aa, Bacillus licheniformis
MNLAKRVSALTPSATLAITAKAKELKAAGHDVIGLGAGEPDFNTPEHIIEAAVRSMNEGHTKYTPSGGLAALKDSIRDKFKRDQGIEYSQSEVIVCTGAKHALYTLFQVLLDEGDEVIIPTPYWVSYPEQVKLAGGKPVFVEGLEENSFKISPEQLEKAVTEKTKAVIINSPSNPTGMMYTEEELKALGEVCLRRNVLIVSDEIYEKLIYGGKKHVSIAQLSPELKNQTVIINGVSKSHSMTGWRIGYAAGSEPIIKAMTNLASHSTSNPTSVAQYGAIAAYNGPNEPVEEMRKAFEERLNKVYELLVDIPGLTCLKPEGAFYLFPNAKKAAESCGFSSVDEFAEALLEEEKVAIVPGSGFGAPDNIRLSYATSLSLLEEAVERIRRFVVNRSR

SEQ ID NO: 6469 - protein, 161 aa, Bacillus licheniformis
MGKKTLIFILIFGIIFLTALLAGANVYRTAMDQKENGHEQAAETARQEAGLKQVDSVETFVGKEKQYIVTGADKKGDKMYVWVPADKKQKTLYKKASAGITGRQAAKAVQDEGLMSELKEVHLAREGNVLLWEVTYLNKDGQYSLSYVDFINGKIHKNITP

SEQ ID NO: 6470 - protein, 56 aa, Bacillus licheniformis
MENKIEILSTVSVEHSEDLYKIVDLLNRTLKRDDLMFGLALDEEDQKQAIFTIYRT

SEQ ID NO: 6471 - protein, 930 aa, Bacillus licheniformis
MNNQRYVVIDVETTGNSPKKGDRIIQIAAVVIENGQITERFSKYVNPNQPIPAFIEQLTGISNEMVENEEPFSAIAEDIFELLHDSCFIAHNIHFDLAFVKHELQLAGFGEIECSVLDTVELSRIVFPGFDGYKLTELSEELQIRHENPHRADSDAEVTALIFLHMMDRLKRLPIPVLKSIRRLSWHLISDAQELFDGLIAEKGADAELEAGFTKVGSFVIRTPEVEDEEAGHKSRVPQTEPLIWERDGGLSSLDDRFDKREGQTKMMREVWTAFQNHEHALIEAATGIGKSLGYLVPAAIHAKQTGKPVVISTYTTLLQQQMINRDIPLLEKIFPFPVKAAVLKGRSHYLSIRKFKHILQEDDDNYDSVLAKAQILVWLTDTETGDLSEINLPSGGKLLWDRLAYDSHSYAESSNMRKLCFYERAKARAQKADMIITNHALLLTDETNQRIHTGDADMFIIDEAHHFERAAGEQYGARADYVFLHKRLMRLGTLKQRGILKKAERLYRSAGISSESFFQMDEWLAQLLEESDLFFTAVHSFVKRRKPRNDLNRLLYKIGETGESRAWSRLEEGARRLCSMLYDMHRLFMDQKKSLAEKQASFTSRQAFLLEEYDSCMNDLEEYRKTLGRLMFDPVEDEVVWIEIDAKGAKNAAAIYAQPLDTSEILADRFFTEKKSVVLTSGTLVVENSFDYMIKKLGLSDFYPRTLQIESPFSYDKHMNIMIPTDVSPIQNDPGDYIQDVSRYVKALAKQKDAKVLVLFTSHDMLRDVYHTLKNEEDFPCQLLAQGISGGSPVKVMKLFKSYPHAVLLGTNHFWEGVDFPGDELTTLIIARLPFRPPDHPVESAKCDRAKRRGESPFQAVSLPEAVLAFRQGIGRLLRSEKDSGTVVILDRRIRTSSYGTVFMKALPPAKVMEPTFLELEAYIAGKNG

SEQ ID NO: 6472 - protein, 127 aa, Bacillus licheniformis
MYRTLMSAKLHRARVTEANLNYVGSVTIDEDLLDAVGMMANEKVQIVNNNNGARLETYIIPGERGSGVVCLNGAAARLVQVGDVVIIVSYAMMSEEEAKTHKPKVAVLNERNEIEEMLGQEPARTIL

SEQ ID NO: 6473 - protein, 288 aa, Bacillus licheniformis
MIQIYTAKDIQNLTKNYRKEGKTIGFVPTMGFLHEGHMSLVEKARKDNDIVVMSIFVNPMQFGPGEDYEAYPRDIERDRQLAAGSGVDVLFTPEPEEMYGQEPTVTASVKKRTDVLCGRSREGHFDGVATVLTKLFNLTSPTRVYFGMKDAQQVAVVDGLINDFFMDIELIPVETKREEDGLAKSSRNVNLRAEERQEATALYRALQRGAELIRNGERDPEAVKREIRSILEKTSGVIDYADIYSYPDLEIRDPLTGKVIIAVAVQFSKARLIDNIIVDIPADQKEDL

SEQ ID NO: 6474 - protein, 277 aa, Bacillus licheniformis
MKTKTDFLKMKQEGEPIVMLTAYDYPAAKLAEQAGVDMILVGDSLGMVVLGLDSTVSVTVADMIHHTKAVKRGAKDTFVVTDMPFMSYHCSLESALKNAAAIVQESGADALKLEGGDGVFETITALTRGGIPVVSHLGLTPQSVGVLGGYKVQGKDEESAGKLIEDSRRCEEAGAMALVLECVPAALAERISKELTIPVIGIGAGAGTDGQVLVYHDVVGHGVSRTPKFVKQYAQIDQPLEQALRGYVEDVRSRVFPEDAHSFRIDQQVLEGLYGGK

SEQ ID NO: 6475 - protein, 327 aa, Bacillus licheniformis
MQSNLRKKLIQLFTEADGEFISGQKISEELGCSRTAVWKHIEDLRKSGYELEAVRKLGYKMIKKPDKITEDEIRLGLKTKKMGQTIHFQDVVSSTQKIAHELANNGAPEGTIIVADKQTEGRGRMARAWHSPEGNGIWMSIILRPEIPVQKTPQLTLLAAVAIVQAIEEQTGIAAEIKWPNDILINGKKVVGILTELQAEADQVHSVIVGTGINVNQLAADFPEELQETATSLRLASGEKIDRAALVQTIMSTFEKRYEDYLAYGFEPIKLLWESYALTLNRELTARTLNGTFHGKALGIDEEGVLILETSDGIKKIYSADIDINPS

SEQ ID NO: 6476 - protein, 397 aa, Bacillus licheniformis
MEDLFLKALPLLRELKKHGWQAYFVGGAVRDAQMNRDVGDIDIATDASPEEIEAIFPKTVDVGKEHGTIIVLFEGESYEVTTFRAELEYEDYRRPSGVQFIKSLKEDLKRRDLTINAMAMDEEGRLIDYFGGLRDIRERLIQTVGDPAERFHEDALRMLRALRFMSQLEFELSPNTKKAICENRPLLAHISTERKTVEFEKLLKGKAAGRALEAAAETGLYKELPGLDGKKERVLAARAFPFYQLQKSADIWAAFIHMISINPAEAHRFLKGWKLPGKVIRQALHTAERIDQKWDAVSMYEAGEETLLAASAIRSLRDKQAIDEEQLAEIRQSYQALPIKSLKDLAVSGSDLLNFRKKPAGKWVSDDLKRIERAVLNGELANQKKAIEEWLDSCSQI

SEQ ID NO: 6477 - protein, 393 aa, Bacillus licheniformis
MKQLKIGITCYPSVGGSGIIATELGKLLAEKGHEIHFITSSVPYRLNKVYSNIYFHEVEVNQYAVFKYPPYDLALASKMAEVAKREQLDVLHAHYAVPHAISAFLAKQMLNGNIKTVTTLHGTDITVLGYDPSLKDLIKFAIESSDRVTAVSSALAAQTYDLIKPNKKIETIYNFVDERVYLKKQEHHSLKEQYGIAPDEKVIIHVSNFRQVKRVQDVIHVFSRIVKQMKSKLILVGDGPEMTVICQLVRQLGLKDDVLFLGKQDSVEELYAISDLKLLLSEKESFGLVLLEAMACGVPCIGTNIGGIPEVIKNGVSGYLVDVGDIEGAASKALHLLTDESLQRQFAEAALQSIKERFSSNKIIAQYEEIYQQLTDWECDNGGSLFEGSSSPS

SEQ ID NO: 6478 - protein, 245 aa, Bacillus licheniformis
MSSETLSTAGIAMLDILAFGAHSDDVEIGMGGTIAKYTKKGFQIGICDLTQAELSSNGTVETRKSEAALAAEILGASPRISLTLPDRGLFPSQAAIRDVVAVIRKHKPKLVFVPYPKDRHPDHGHAAEIVEEAVFSAGIHKYEDAEKQPAHKVQNVYYYMINGFHKPEFVIDISETINQKKDGLAAYQSQFTRSRQSVETPLTNGYIETVEAREKLLGKEVGVAYAEGFFSKRTLLLNNDLFGGG

SEQ ID NO: 6479 - protein, 137 aa, Bacillus licheniformis
MKIALIAHDRKKQDMIQLTTAYKDILKKHELFATGTTGLKITEATGLPVVRFQSGPLGGDQQIGALIAKNDIDLVIFLRDPLTAQPHEPDVSALIRLSDVYAIPLATNMGTAEILIRSVEEGAFEFRNIVHGRDRDA

SEQ ID NO: 6480 - protein, 267 aa, Bacillus licheniformis
MQKDTIKIAIAGPRGRMGSEAVKLVEDTAHFELVGAIDRTYNREKLSDVMTSSSDAVIYTDITECFSETSPDVLIDLTTPEIGKLHTKIALEHGVRPVVGTTGFSESDLNELMELTDEKGIGAIIAPNFALGAVLMMKFSQMAANYFTDVEIIEQHHDQKLDAPSGTALKTAEMISAVREAKTQGHPDEKEILPGARGADQNGIRLHSVRLPGLIAHQEVMFGGDGQTLKIRHDSYNRASFMSGVKLAVEQVMKIDQLVYGLENIIE

SEQ ID NO: 6481 - protein, 112 aa, Bacillus licheniformis
MTKEKTMKDIQREVDEYIGQFKEGYFSPLAMMARLTEELGELAREINHHYGEKPKKKTESEKKIEEEIGDVLFVLVCLANSLHISLDEAHDMVMEKFNTRDKDRWTRKEEGK

SEQ ID NO: 6482 - protein, 232 aa, Bacillus licheniformis
MLNIPVFFIGWKLLGRTVFSYTILGTVSLSVFLWIFQRFQIHMPLQNDLALAALFAGVFIGTGLGIIFRYGGTTGGVDIIVRLINKYFQVPMGKAMFVFDACVITLSLIFYLSYKEAMYTLVAVFVASKVIDFMQEGGYAAKGATIISEKNDQIQRKIIEEMERGVTVLKGQGSYTKTERDILYCVVPKNEVFQLKNVITSVDPHAFVAVSDVHDVLGEGFTLDENKNPITR

SEQ ID NO: 6483 - protein, 266 aa, Bacillus licheniformis
MIRKVILCMMLALVFPAAGLKAKESSALQELTELSDTVFQLTRQSQYEEAVQILQYFEKRLKAAEKDGTEDMMTGSEIRQVSLAYHDTLKSLESEEVAHQEKFKAAAQFRMLMDAIESDHDPLWSSLKKPIMDSFSALKAGIQKEDNLTFREKWNHFLSLYDTIYPSLTIDVSPKQLKSVSNHIAVVENGGFQQMTESSKLERLTLLEKDLEDVFDQVEEDDADPSLLWVILTTGSIILSTLTYVGFRKYKAEEDRRRKREKDWPK

SEQ ID NO: 6484 - protein, 197 aa, Bacillus licheniformis
MIALKLISYMLAQKPMLLLLLIINFFGTVYGYYWYLPQLTNTPAKFLIFVPDSPTATLFFLFVLIGLLLGRNAPLFEALALVTLVKYGLWAVVMNVLVLVVTGSLHWTGYMLIASHFAMAVQGVLYAPHFRFKGWHLALAAVWTMHNDAIDYLFGMMPNYSMLDQYMPQIGYFTFWLSIASIGLAYYLVLSRKAFKL

SEQ ID NO: 6485 - protein, 254 aa, Bacillus licheniformis
MKRGKGMKFVGDSRIPAERKPNIPKDYSEFPGKTEAFWPNFLLKEWMVGAVFLVGFLVLTIVHEPPLADGRSDRYRLHTFARLVFSISLPIAEIRICCRTYTVVGAIIIPTIAFGALLLAPFLDRGPERRPFKRPVAVGLMLLAISATVFLTWQSVVTHDWAAAEEQGKIKEEADIDTSAEGYKIYQEQGCISCHGDNMQGGAAGPSLVDNGLSPEEIAKIAKEGKGEMPAGVFKGSDKELKELSKFISETTAK

SEQ ID NO: 6486 - protein, 224 aa, Bacillus licheniformis
MLNKIYDWVDERLDITPLWRDIADHEVPEHVNPAHHFSAFVYCFGGLTFFVTVIQVLSGMFLTMYYVPDIKNAWESVYYLQNEVAFGQIVRGMHHWGASLVIVMMFLHTLRVFFQGAYKKPRELNWIVGVLIFFVMLGLGFTGYLLPWDMKALFATKVGLQIAEATPLIGSEIKTLLAGHPDIVGAQTLTRFFAIHVFFLPAALFGLMAAHFIMIRKQGISGPL

SEQ ID NO: 6487 - protein, 168 aa, Bacillus licheniformis
MSEKRHRVSRRQFLNYTLTGVGGFMAAGMLMPMVRFALDPVLRPTEDQDMVQVVSVDELTNEPQRFDFKIKQVDAWYESEESRSAWVFKSGDEIVALSPVCKHLGCTVNWNSDPKNPNKFFCPCHYGLYEKDGTNVPGTPPLAPLDRYEQEVKDGYLYLGKAKPRKDG

SEQ ID NO: 6488 - protein, 54 aa, Bacillus licheniformis
MKWNTHDADVYLNAKEYIDTAVIPLISVDLGDQFNRPYQKGNLRLYLQKNSKGS

SEQ ID NO: 6489 - protein, 179 aa, Bacillus licheniformis
MQTPVSVNEKKDFIRWFLNHYQLKRRECVWILNYLMSHDSLMEKVHFVEQAEFCPRGIIMSTHCVEEVPFRFYKENVMTTDAEKSFHDIRLNKQQDLFIQLNFRSAYNSPEYAAVLEANPHIPKDLYENEKDKIVAEQILEHSIATFQRQKLLREIDEALDRQDKESFEKLAKQLSQLR

SEQ ID NO: 6490 - protein, 424 aa, Bacillus licheniformis
MNTSIQEAIKLVEAGHPESGLKKLADIESDLHDEDKAIVAQLYYEWGIVDKAIAIVTDLHELYPDETELTCFYAELLIETDQEEKALSVLETIPETDEAYPQCLLLMADLYQMQGLFEVSEQKLLKAQAILPDEPVIDFALGELYFTQGAYGKAVRQFKKAAEEEAVIGGVNVYQRLAESLSSSGAFEEALEWYEKAVKENPEPNTLFGFGFTALKAGYPKTAIKQLTELKEMDPAYSSLYKPLANSFETEGLYEEAFETAKEGIRVDEFNKELYLSAAKAALKTKRHSEAKELLREALALDPGYLEAVHTLLALFLEEEDDESIIELVREVRKYGEDDPKFSWHLASAFARTEAYDKAREEYENAFLHYRDDADFLYEYSMFLLEEGRRKEALPLLKKLAELDPANEEVQETIFRIEDENSFE

SEQ ID NO: 6491 - protein, 464 aa, Bacillus licheniformis
MFSESAFNPMKIENAPKNASKPAQNTKHFMLIEVEHMKRGKISSLKGELHIPGDKSISHRSVMFGAMAEGKTVIKNFLPGADCLSTIACFRKMGVEIEQNGSDVTVRGKGLDQLAEPAELLDVGNSGTTIRLMLGILAGRPFHSTVAGDESIAKRPMKRVTEPLRKMGAKIDGRAGGEYTPLSVRGGHLKAIDFQSPVASAQIKSAVLLAGLQAEGTTTVTEPHKSRDHTERMLSMFGVSLREDETSVSIEGGQQLKAAEVFVPGDISSAAFFLAAASLVPGSEVVLRNVGLNPTRTGIIDVLKEMGADLEIEEKDTGNTEPYGDLRIKTSSLKAAEISGDLIPRLIDEIPIIALLATQAEGTTVIKDAAELKVKETNRIDTVASELKKIGANIEPTEDGMKIHGKTPLTGGAKVSSHGDHRIGMMLGIAACICEQPIDILQPEAVSVSYPSFFEHIEKLAEKA

SEQ ID NO: 6492 - protein, 371 aa, Bacillus licheniformis
MTQPNETILLAGLGLIGGSIALAIKKEHPGKRIIGFDVSEEQARAAQKLGVIDAPAASFLEGVKEASTVFLAAPVEQTLHMLDELAASGIKKKLLITDVGSTKQKVVSHAEKVLPDDYRFIGGHPMAGSHKSGVAAAKDFLFENAFYILTPSGSAGKEAVASLKDLLKGTNAKFVEMSPAEHDAVTSVISHFPHIVAASLVHQTVKFEDQYPLVKRFAAGGFRDITRIASSSPAMWRDILLHNKDKILERFDEWKQELDRIQSFVENEDADGLFEFFRQAKEYRDGLPLRQKGAIPSFYDLYVDVPDHPGVISEITAILADEQISITNIRIIETREDINGVLRISFQSDEDRKRAEKCIQTRAKYETFYAD

SEQ ID NO: 6493 - protein, 360 aa, Bacillus licheniformis
MQIKEQLKQLTPYQPGKPIEEVKKEFNLDRVVKLASNENPYGCSEAAKEALQIEVQQMALYPDGYSAALRTKLASHLGVNETNIILGNGTDEVIQIISRSLLDPASNTVMANPTFSQYKHNAVIEGAEVREVGLLENGCHDLDAMLKAIDEQTKVVWVCSPNNPTGTYESGRNLIRFLEKVPEHVLAVVDEAYYEYVTAEDYPETIPLLERFPNLMILRTFSKAYGLASLRVGYGIASEQLIQAIEPARQPFNTNRLGQAAALAALGDQAFIHDCVRKNNEGLKQYYDFCDEHGLNYYPSQTNFVLIDFKRDADELFSELLKKGYIVRSGNALGFPTFLRISVGTKEQNEGFLKTLAGML

SEQ ID NO: 6494 - protein, 267 aa, Bacillus licheniformis
MFNLKKQPSDKLFVPFITAGDPLPEISIELAKSLQEAGASALELGVPYSDPLADGPVIQRASKRALDNDMNIVKAIRLGGEMKKNGVHIPIILFTYYNPVLQLDTDHFFALLRQNQLDGLLVPDLPFEESVYLQQQCKKHGITYISLVAPTSESRIQKITQQAEGFVYCVSSLGVTGVRNEFEDSVSSFIRSVKGMSSVPVAVGFGISSSKQVEMMNELADGVVVGSALVRKIEELKDELVAPETREQALKAFEAYAKTFSGSYMVK

SEQ ID NO: 6495 - protein, 408 aa, Bacillus licheniformis
MYSYPNEQGRFGDFGGKFVPETLMQPLEEIEKAFLELKDDPSFQKDYQKLLNDYSGRPTALTFADQLTKQLGGAKIYLKREDLNHTGAHKINNALGQALLAKKMGKTKLIAETGAGQHGVAAATVAAKFGLSCIVFMGEEDVARQSLNVFRMKLLGAEVVPVSSGNGTLKDATNEAIRYWVQHCQDHFYMIGSVVGPHPYPYIVREFQRMIGEEAKAQFYQLEQSLPDKVVACVGGGSNAIGMFSAFIEETVELIGVEAAGKGVDTPLHAATITKGTKGVIHGSLTYLIQDEYGQIIEPYSISAGLDYPGVGPEHAHLHQTGRVTYESVTDDEAVSALRLLTETEGILPAIESAHALAKAFEIAKELPREKSVLVCLSGRGDKDVHTLMKVLEEEVNQDVQSEKTAVR

SEQ ID NO: 6496 - protein, 178 aa, Bacillus licheniformis
MKKPSLKYCGIHSLEDLKVTARSKADYLGFIFAESKRSVDPADVKRWCGETDTPGKKLVGVFVNENMSRMAEIVKDAGLDVIQLHGDETAADIKRLKSMTDCEIWKALPHGNDTVQSMASFAPYIDGYVIDSSVKGMRGGTGVSFSWDSVPLYIDAAQREGKRLFIAGGVNPDTIADL

SEQ ID NO: 6497 - protein, 252 aa, Bacillus licheniformis
MLNQIIDRKREDILKIKLSEDLKLPKRSFKKALLSPNRFVALIAEVKKASPSKGVIQEGFEPVKIAKQYEQAKADCLSVLTDTPFFQGKNSYLSDVKRSVSLPVLRKDFIIDSIQVEEADRIGADAILLIGEALEPQKLFELYQQAVEKGMDVLVEVHGEETLEGILNVFTPEIIGVNNRNLKNFETTVGQTERMAKLVPPGTVLISESGIGKSEDLTFVKTCGAQAVLVGESLMRETSQLKAVYALFGEDG

SEQ ID NO: 6498 - protein, 338 aa, Bacillus licheniformis
MNELLKSCVNGRTLNEIEAHSIMRDMMTGSLSAAEIGGLLSVLAYRGETAEEITGFVRAMREQAHTIDGPEHVVDTCGTGGDGSSTFNISTAAAIIASSAGAKIAKHGNRSVSSKSGSADVLEYLGVSIQTSPEETIKSIERRNMGFLYAPSYHSSMKHVAGARKDLAFRTVFNLLGPLSNPMKAKRQVIGVYSIEKAKLMARALEAFEPEHVLFVSSRDGLDELSITSPTDVIELKGGKTYEYTVEPGDVGLPLGRLRDIQVATPEESGRLIVDILKNRGPDSAVHIAAFNAGAALYVAEQAADLKEGVALALEAVAGGEALNQLERLKQKEEELYA

SEQ ID NO: 6499 - protein, 515 aa, Bacillus licheniformis
MSLQTDFASFSEDSSHFKTIPIIESFSVDTLTPVQLVEKLQEDIVYLLESQDETSAWSRYSFIGLDPFLTIKEERGRFHACDQKQKKLYSASQLKDVLEWMSETYSIKAPELDIPFTGGAVGYLSYDLMPLIEPSIKGHSKETEMAKCLLFVCRTMIAYDHELKKLHFIHYTRLEGSENREEKRRIFKKGKEELKQLTHRLSDRKTPKELFLPQGRHTAPSFEGIQSTYEKSRFLADVDRLKEYIKAGDIFQGVLSQRFDIPVKVGSFELYRVLRMINPSPYMYYMRLPDRDLVGSSPERLIHVQNGHLEIHPIAGTRKRGGDQAEDKRLEKELLADEKEKAEHYMLVDLARNDIGRVAEYGSVQVPEFTKIVSFSHVMHIISIVTGTLKAGVHPVDALMSAFPAGTLTGAPKIRAIQLLNELEPEPRETYGGCIAYIGFDGNIDSCITIRTMSVKNGVASIQAGAGIVADSVPEKEWEETCNKAGALLKTIQIAEETFLEKGEDGNERTAEIMR

SEQ ID NO: 6500 - protein, 127 aa, Bacillus licheniformis
MMMRGIRGATTIDRDTEKDITERTKQLIGKMIDENRLKPEQVVQILISATSDIHAAFPAKVVRTFDGWQHVPVMCMQEMDVEHGLKKCIRVMMTVQTDMRQDEVRHVYLENAVTLRPDLSLTKNTEL

SEQ ID NO: 6501 - protein, 362 aa, Bacillus licheniformis
MKSLQIETASLSYPVFIGGGIRKNAAELLSSLNLPMTKLLLITDEEVDKRYGEELFSLLRSKWPVKKVAVPSGEQAKSIDMFMKLQTEAIQFHLDRSSCIVALGGGVVGDLAGFVASTFMRGIDYVQFPTTLLSHDSAVGGKVAINHPLGKNLIGAFHQPKAVVYDTECLSTLPEKEMRSGLAEVIKHAFIRDESFLNELLKLDSIEAITTGQLSEMVYKGISIKAEVVSQDEREQGIRAYLNFGHTLGHAVEAEYGYGEITHGDAVALGMQFALFVSEKVLNCPVDRTKIAAWLKNLGYPESVKREVSTEALIYRMMNDKKTRGGIIQFVLLDKIGSVRLHSFKAEEIERWLNMWRLEGDK

SEQ ID NO: 6502 - protein, 390 aa, Bacillus licheniformis
MRYLTAGESHGPQLTTIIEGVPAGLYITKEDIDYELQRRQKGHGRGRRMQIEKDQARITSGVRHGRSLGSPIALVVENNDWKHWTKIMGSEPITAEEESEMKRQISRPRPGHADLNGAIKYGHRDMRNVLERSSARETTVRVAAGAVAKKILSQLGIQVAGHVLEIGGVKAEKTNYESIENLKKVTEESPVRCYDEEAGRKMMDAIDEAKANGDSIGGIVEVIVEGVPVGVGSYVHYDRKLDSKLAAAVLSINAFKGVEFGIGFEAARKNGSEVHDEIIWDEEKGYTRATNRLGGLEGGMTTGMPIVVRGVMKPIPTLYKPLKSVDIETKEPFTASIERSDSCAVPAASVVAEAVVAWEIANAIVEQFGVDQMDRIAENVEKMRKLAREF

SEQ ID NO: 6503 - protein, 255 aa, Bacillus licheniformis
MDNYSFFVDKWKKMTGVDLALYKEAQMKRRLTSLYEKKGYGDFREFALALEKNEALLQETLDRMTINVSEFYRNYKRWEVLEKTILPLLKPAKTLKVWSAACSTGEEPYTLSMILSRQKGLTDYQIIATDIDDKVLQKAKEGVYQERSLQEVPKEMKELYFTQDGNRFKVKDEIRKNIRFQKHNLLADPYEKDFDIIVCRNVLIYFTEEAKEKIYHKFSGSLKNKGILFVGSTEQIFNPEKYGFQSTDTFFYQKS

SEQ ID NO: 6504 - protein, 148 aa, Bacillus licheniformis
MEKTFVMVKPDGVQRQLIGEILLRFERKGLQLIGAKLMKVSEETAGEHYKEHNGKPFFGELVDFITSGPVFAMVWEGEDAIAVARQLIGKTNPKEALPGTIRGDFGMFVGKNIIHGSDSPESAAREINLFFKEDELVEDEKLMNQWIY

SEQ ID NO: 6505 - protein, 320 aa, Bacillus licheniformis
MKLTTFYSFLNDDIELIEKELEKTVHSDYPLLSEASLHLLQAGGKRIRPVFVLLSGMFGEYDISKIKNVAVSLELIHMASLVHDDVIDDAELRRGQPTIKAKWDNRIAMYTGDYLFARSLEAMTKINEPKAHEILSKAIVEVCLGEIEQIKDKYNMEQNLRTYLRRIRRKTALLIASSCQLGAIAAGAGENIHKTLYWFGYYVGMSYQIIDDILDFTSSEKELGKPVGSDLLQGNVTLPVLYARKSPELKARLMLVNSETTPEQIKPVIEELKKTDAIEQSFRVSEMYLNKAFELLETLPKNRARTALGQIAKYIGKRKF

SEQ ID NO: 6506 - protein, 232 aa, Bacillus licheniformis
MVQSKEQRVHGVFEKIYKNYDQMNSVISFKQHKKWRDKTMQLMNVPKGATALDVCCGTGDWTIALADAAGETGEIKGLDFSKNMLSIAEQKTESYSQIELIHGNAMELPFPDNTFDYVTIGFGLRNVPDYLTVLKEMARVVKPGGQVVCLETSQPEMFGFKQLYFLYFRFIMPMFGKLFAKSFKEYSWLQESAREFPGMKELAALFEEAGLKNVQYHPFTGGVAATHVGWKR

SEQ ID NO: 6507 - protein, 258 aa, Bacillus licheniformis
MQDIYGQLSYLKIKLNQKLSHPYLAKHLTAPKVDEDKLFLFYALFEETDLKEADKESYILTAMLVQTALDTHDEVTTAASIKQDDYKNRQLTVLAGDYFSGMYYSLLSGMKDIYMIRTLAAAIKEINEHKIRLYDHSAKDADSLKKSVSIVEAALFHHLADHFYLPHWKTAANDFLVFKRFAAEEKASDSRLLETIIQKEFPEGQASCGQLAAAAYKEAKLAINQSLAKKPAVQKWLLKRLQEIRPEKRTYHQKVEEG

SEQ ID NO: 6508 - protein, 78 aa, Bacillus licheniformis
MNMTNNQSNDFVVIKAVEDGVNVIGLTRGTDTRFHHSEKLDKGEVMICQFTEHTSAIKVRGEALIQTANGEMKSESKK

SEQ ID NO: 6509 - protein, 189 aa, Bacillus licheniformis
MREINKDQIEQAVRQILEAIGEDPNREGLLDTPKRVAKMYAEVFAGLNEDPKEHFKTIFGEDHEELVLVKDIPFYSMCEHHLVPFYGKAHVAYIPKGGKVTGLSKLARAVEAVAKRPQLQERITSTIADSIVETLTPHGVMVVVEAEHMCMTMRGVKKPGSKTVTSAVRGTFRQDVAARSEVLELIKTS

SEQ ID NO: 6510 - protein, 92 aa, Bacillus licheniformis
MNKTELINAVAEASELSKKDATKAVDSVFDTILDALKNGEKIQLIGFGNFEVRERSARKGRNPQTGEEIEIPASKVPAFKPGKALKDAVAGK

SEQ ID NO: 6511 - protein, 492 aa, Bacillus licheniformis
MEKVDIFKDIAERTGGDIYLGVVGAVRTGKSTFIKKFMELVVLPNINNEADRARAQDELPQSAAGKTIMTTEPKFVPNQAMSVHVSDGLDVNIRLVDCVGYTVPGAKGYEDENGPRMINTPWYEEPIPFHEAAEIGTRKVIQEHSTIGVVITTDGTIGEIARQDYVEAEERVIDELKEVGKPFIMVINSVRPYHPETEALRQELMEKYDIPVLAMSVESMREADVLSVLREALYEFPVLEVNVNLPSWVMVLKENHWLRENYQDSVKETVKDIKRLRDVDRVVGHFSEFDFIERASLAGIEMGQGIAEIDLYAPDYLYDEILREVVGVEIRGKDHLLQLMQDFAHAKTEYDQVSDALKMVKQTGYGIAAPALTDMSLDEPEIIRQGSRFGVRLKAVAPSIHMIKVDVESEFAPIIGTEKQSEELVRYLMQDFEDDPLSIWNSDIFGRSLSSIVREGIQAKLSLMPENARYKLKETLERIINEGSGGLIAIIL

SEQ ID NO: 6512 - protein, 238 aa, Bacillus licheniformis
MKIVNVLLAILLTAIMLSGCLYPEERKAKNSAPHQHQLKEVQAAVDEFREATGGLLPIKTRDMGVPIYQKYPIDFNRLSPRYMAEPPGTSYENGGEYLYVLVDVEKKPTVKLIDVKMSEMIRELKLRVEMYKDQHKYPPYKKVVSKNLFMLDHEKLGLKEAPSVTSPLSGTSLPLLVDEKGDIKVDYRMDLAKLMKKSKKTVKPGEEVQDLMWEETPFVPAFSVKYTVNDKQEPVFLE

SEQ ID NO: 6513 - protein, 67 aa, Bacillus licheniformis
MNVGLLKMWFALGSMGLMFLAVIAIYISRYKFKNRFLKIITSFVAYTCMLISGVIVFFVVFSGPVNE

SEQ ID NO: 6514 - protein, 346 aa, Bacillus licheniformis
MTKVSILGAGSWGTALALVLADNQYDVCIWGHREELIQQINEHHENKDYLPGVKLSENVRATTDLEAAVADVKTIIVAVPTKAIREVLAQAVSFINQKAIFVHVSKGIEPDTLLRISEMMKEEIPAELREDIVVLSGPSHAEEVGLRHPTTVTVSADSSIESAQAIQDMFMNQNFRVYTNPDMIGVEIGGALKNVIALAAGITDGLGYGDNAKAALITRGLAEIARLGTKMGGNPLTFSGLTGIGDLIVTCTSVHSRNWRAGNMLGKGFKLDEVLEEMGMVVEGVRTTKAAYQLSKKFDVKMPITEALHKVLFDGEKVETAVESLMARVKTHEMEDLVNTFENQMK

SEQ ID NO: 6515 - protein, 436 aa, Bacillus licheniformis
MGKPVVAIVGRPNVGKSTIFNRIAGERISIVEDTPGVTRDRIYSSAEWLNHDFNLIDTGGIEVGDEPFLAQIRHQAEIAMEEADVIIFMTNGREGVTAADEEVAKILYRTKKPVVLAVNKVDNPEMRANIYDFYALGFGEPFPISWTHGLGLGDLLDAVSEHFKNIPETKYEDEVVQFCLIGRPNVGKSSLVNAMIGEERVIVSNIAGTTRDAIDTRFTYNQRDFVIVDTAGMRKKGKVYEATEKYSVLRALKAIDRSEVVCVVLDGEEGIIEQDKRIAGYAHEAGKAVVIVVNKWDAVEKDERTMKEFEEKVRDHFQFLDYAPVLFMSALTKKRIHTLMPAVMTASENHSMRVQTNILNDIIMDAVAMNPTPTHNGNRLKIYYATQVAVKPPTFVVFVNDPELMHFSYERFLENRIRDAFGFEGTPIRIFARARK

SEQ ID NO: 6516 - protein, 64 aa, Bacillus licheniformis
MSESIEKFILAVVTTRRDRVIGGTAAFFCDTPEEMNTYAKNLEAILDGIAHGIGDDLYLIVKHF

SEQ ID NO: 6517 - protein, 299 aa, Bacillus licheniformis
MSQYTYPIILGIVAGIVVRVYMLRTDYRQYPTYLHGKTIHIALALIAASIGAIIIPSILKSDYTAITFLTLAATQFRDVRNMERETLTQLDGYELVSRGSTYIEGIAIAFESRNYIVIFTSLLTTLAYILFSSVWAGLAAALICFIAGRILMSGSFIKDIADIEYKKPHFEGAGLYVDNIYIMNIGLPEKRKLILEHGMGFILKPKNFNSAVTIANLGQRQAILFDVSNVLGVYRDSGEPSLSPLAKRDLNDGRVAVFVLPVIKDKETAIRVIGDVPTLENAIRVPMEFIKEKHSKVIK

SEQ ID NO: 6518 - protein, 200 aa, Bacillus licheniformis
MEEFYYYWSMWFLWVLTTFILEKNRFRFYASAFILLNIILSMYQVRLFMYFNAAYLSFYIGAFMLCGFLRLHKSVKRLLLHLSMVSAYGFLFLFALYDPVWFILKPEWLIIILFVIMTAAFERSFAVRLGVFVLGMCQGELLYTFVIRKLYGDIAAGGYSWLSMCAAGIVLVYGISQYEQLMHQVYHKLKRLNKGAAKMS

SEQ ID NO: 6519 - protein, 43 aa, Bacillus licheniformis
MGKDRQEKKLKQQKRTESDRDQSISYNGAASLESAEDARKRNP

SEQ ID NO: 6520 - protein, 351 aa, Bacillus licheniformis
MMVTRAKRKKEHIDHALSTGQKRQTGLDDITFVHVSLPETELSQVDTSTKIGELFLSSPIFINAMTGGGGKATFEINRALARAAAQTGIPVAVGSQMSALKDPDERPSYEIVRKENMKGLVFANLGSEATVEQAKRAVDMIEADMLQIHLNVIQEIVMPEGDRNFTGRLRRIEDICRSVSVPVAVKEVGFGMSRDTAARLFNVGVQAIDVGGFGGTNFSKIENLRRDKAVEFFDQWGISTAASLAEVSSISGDRPIIASGGIQDALDLAKSIALGASAAGMAGYFLKVLTASGEEALAAEIESLIEDFKRIMTVLGCRTIEQLKKAPLVIKGDTYHWLKARGVDPFVYSMR

SEQ ID NO: 6521 - protein, 382 aa, Bacillus licheniformis
MTEEMNQIDVQVPEVGDVVKGIVTKVEDKHVDVDIPNCKQTGIIPISELSSLHVEKASDVVNVDDELELKVTKVEDDALILSKRAVDADRAWEDLEKKFESKEVFEAEVKDVVKGGLVVDIGVRGFIPASLVEAHFVEDFTDYKGKTLTLIVVELDRDKNRVILSHRAVVEKEQSERKQEFLQTLEAGQVLEGKVQRLTDFGAFVDIGGIDGLVHISQLSHSHVEKPSDVVEEGQDVKVKVLSVDRDNERISLSIKETLPGPWSNIGEKVKPGDVLDGKVQRLVSFGAFVEVLPGVEGLVHISQISNKHIGTPHEVLEEGQDVKVKVLDVNEEEERISLSMKELEENTDKAEQEDYRQYQAKEESSGFQLGEMIGDKLNKLK

SEQ ID NO: 6522 - protein, 226 aa, Bacillus licheniformis
MEKKLCIAIDGPAAAGKSTVAKIVARKKSYIYIDTGAMYRAITYLALEKGVDLNDEAALTALLKESAIDLTVSPEGEQKVYIAGEDVTEAIRTDSVSNQVSIVAKYAGIREEMTKRQQQLAEKGGVVMDGRDIGTHVLPNAEVKIFLLASVEERAKRRFEENVKKGYNVNYETLAEEIRRRDKLDSEREISPLKKADDALEIDTTSLTIDEVAEKILQIVDKKAQK

SEQ ID NO: 6523 - protein, 58 aa, Bacillus licheniformis
MKTIERLLFKILVVQTVILISVQLLFHFSKAEPYLSKVVQYEGVNNMKIGEWIETFKP

SEQ ID NO: 6524 - protein, 450 aa, Bacillus licheniformis
MIRGILIALLGVAIVGTSYWGYKEHQEKDAVLLHAENNYQRAFHDLTYQVDQLHDKIGSTLAMNSKKTLSPALAEVWKTTSEAHNNVSQLPLTLMPFNKTEEFLAKVGDFSYKAAVRDLDKEPLNKKEYASLNQLYENSKDIQNELRNVQHLIIDKNLRWMDVELALASGQKQSDNKIINGFKTVEKSASAFSDTDLGATEMTNTKKEQQGYDHLQGKRITEKEARKIAQKFAQDKNYNIKVSKSGKKTNRDVYSISMQDPDQKADIYMDITEKGGYPVYLIQNKKIKDEKISLNDASNKALQFLKKNGYKTEDLKMDESSQYDGVGVFSFVPVQDDVWLYPDSIRIKVALDDGEITGFNAKDFLISHKKRDLPKPKLTPEKAKASLNPNVKVQETRLALVTNELSQEVLCYEILGTIENDTFRMFINANDGTEEKVQKMKSAEPIYNDL

SEQ ID NO: 6525 - protein, 321 aa, Bacillus licheniformis
MKSKGSFCLNVILCTIMATSLSLPFSQKSAAFSEQVIQRGATGDDVIELQARLQYNGYYNGRIDGVYGWATYWAVRNFQNQFGLRDTDGLVGPKTKRLLINHTKYYSDYVHRQLRKGNQFTHYGGLPLKYQTKPSKEVQQQARKKAEARQRQGAQQQGTAQKQPQQKQQAAPAQPKKQAQPKAAPKQAAPKKQDAVAANMPGGFSNNDINLLAQAVYGEARGEPYDGQVAVAAVILNRLDSPTFPNTVAGVIFEPLAFTAVADGQIYMTPDETAKKAVLDAINGWDPSENATYYFNPDTATSSWIWGRPQIKRIGKHIFCE

SEQ ID NO: 6526 - protein, 156 aa, Bacillus licheniformis
MFGIISAGLAPGIALLMYFYLKEKYESEPIHMVIRLFILGVLLVFPTMFIQYVLEKEHISEGSFVVSFLTSGFLEEFLKWFLLMVSTFQHIDFDEHYDGIVYGTSLSLGFATLENILYLIGNGVEYAFMRALLPVSSHALFGVIHGLLLPQSPFFG

SEQ ID NO: 6527 - protein, 322 aa, Bacillus licheniformis
MNKKVALITTGGTIASRKTESGRLAAGAISGPELAEMCSLPEDVQIDVYPAFQLPSMHITFQHLLELKQTIERVFQDGGYDGAVVTHGTDTLEETAYFLDLTIEDERPVVVTGSQRAPEQQGTDAYTNIRHAVYTACSPDIKGAGTVVVFNERIFNARYVKKVHASNLQGFDVFGFGYLGIIDNDKVYVYQKPLKRDVHQLQRPLPAVDIVKCYLDGDGKFIRAAVREGVEGIVLEGVGRGQVPPNMMADIEQALNQGVYIVITTSAEEGEVYTTYDYAGSSYDLAKKGVILGKDYDSKKARMKLAVLLASYKEGIKDKFCY

SEQ ID NO: 6528 - protein, 331 aa, Bacillus licheniformis
MPDMTGDERNMKEEKVIIIGGGPCGLSAAIHMQEIGIDALVIEKGNIVNSIYQYPTHQTFFSSSEKLEIGDVAFITENHKPVRNQALSYYREVAKRKNLRINAFEKVQSVTKTENNQFIVETSKDTYLSSFCIVATGYYDNPNYMNVPGEDLPKVFHYFKEAHPYFDKDVAVIGGKNSSVDAAMELVKAGARVTVLYRGNEYSSSIKPWILPEFLSLVKHGKIRMEFRAVVKEITEDELIFSVDGKETRIKNDFVFAMTGYHPDHSFLQKMGVKIDAESGRPFFNEETMETNEEGIFIAGVIAAGNNANEIFIENGRFHGGLIAAEIAKRI

SEQ ID NO: 6529 - protein, 424 aa, Bacillus licheniformis
MVADQNTGHTEENTHDVLKSTQTVIHKALEKLGYPEEVYELLKEPIRFLTVKIPVRMDDGSVKIFTGYRAQHNDAVGPTKGGIRFHPGVTEKEVKALSIWMSLKCGIIDLPYGGGKGGIICDPRDMSFPELERLSRGYVRAISQIVGPTKDVPAPDVFTNSQIMAWMMDEYSRIDEFNSPGFITGKPLVLGGSHGRESATAKGVTICIKEAAKKKNIDIEGASVVVQGFGNAGSYLAKFMYDAGAKVVGISDAYGGLYDPEGLDIDYLLDRRDSFGTVTKLFNDTITNKELLELECDILVPAAIENQITAENAHNIKAKIVVEAANGPTTLEATKILSDRDILLVPDVLASAGGVTVSYFEWVQNNQGFYWTEEEVEERLEKMMVKSFNNIYEMAHNRRIDMRLAAYMVGVRKMAEASRFRGWI

SEQ ID NO: 6530 - protein, 194 aa, Bacillus licheniformis
MRLERLNYNKIKIFLTLDDLTDRGLTKEDLWKDSFKVQQLFKDMMNEANTELGFEANGPIAVEVYSLQAQGMVIIVTKNQETDEDDNEYDEDYIEMQVKLGESVDIIYEFQTFEHLIELSKNLDRIGIQGGTVYHYEGRYFLSLDDFDSLEVDGVISILAEYGNPTTLTIYRLQEYGKKIMENNAVQTIQTYFK

SEQ ID NO: 6531 - protein, 261 aa, Bacillus licheniformis
MIYWLSLASAAFIGLAALVWKMSAIARENRVLKAEFSLGRLKKELNVFFISDIHRRTVSEDIICEVKERGVQLVIIGGDLAEGGVPYTRIEENIKRLSSLGKTYFVWGNNDYEVDQERLLEIFKTYGVTPLRNASVLHDHQGQTVNICGVDDIRLELDDYPAALGGVQPGFPTVLVSHNPEIHHQIQEADGIDLILSGHTHGGQIRFGRFGLCEIGGTGTVFKAPYLISNGYGTSKLPLRLGARPETHLINLVPGPRMEGN

SEQ ID NO: 6532 - protein, 147 aa, Bacillus licheniformis
MGSELEELDRFTDEPTKQMLRALIKRKKKYENYARQTFRWQAVAAICAVSFCVFAASKGIGQNGFLSGLLNDSVYLLWILSAAFAYSTAYYFKKKEEKAEGEYHKLRCEIIQKSTDLWPQPEEWKSRETVFKIMKQQYDINLYFESK

SEQ ID NO: 6533 - protein, 259 aa, Bacillus licheniformis
MTEMSRIERKKREQEKASAEMNREAAAAVELETLDEEIPSRRTYHKKKKSSKKKNKDRNPLFTSLAVMFVFIPIIVFVVFMYMLNQGGDTDPDQYDNVFYENKGETGMTNENQNGEQEADQKAASQHTAAALQEEKLKESKQPENKEDEPSKKDEQKQKERPKEAKKADEQPVAAKKPAASKQPAEQEKKTANAPQTPPVQQAPQPKKVLKHTVGEKETLFRISMKYYKNRSGEEKIRNYNQLSGNNVYAGQVLDIPIY

SEQ ID NO: 6534 - protein, 214 aa, Bacillus licheniformis
MLKKQSEIIRRLSDGEMLKQLYFSQTLMLFTALLMGIFLFDDADAFLSLWNPSDLSILKYGAPLAALVIIADLMVMKWAPKHMYDDEGINEKLFRERSYPHIVILTLFIAFAEEILFRGVIQTHFGLWAASIIFAILHFRYLKKWLLFVMVVSISFLLGLSFERTGNLFVPVTAHFLIDVVFACQIRFQHVRRSSHDGDVKNREEEEGTGEGQR

SEQ ID NO: 6535 - protein, 269 aa, Bacillus licheniformis
MDKLHQALRRYFGYHAFKKGQETIIKSVLEGRDTVAMLPTGGGKSLCYQLPGLLLDGTVLIVSPLLSLMEDQVQQLKMRGEKRAAALNSALTHQEKNDVLNRLHRLKYLYISPEALQSGQMLKKLQLLNVSLFVVDEAHCISQWGHDFRPDYSKLGDIKALLGHPVTLALTATATEATLKDISEILGLKAANYLIHSVDRPNIALHIEKLRDTAEKTERLTGLVQKLQGPGLVYCPTRKWAEELADKLRKEANLRTGFYHGGMEQATGC

SEQ ID NO: 6536 - protein, 352 aa, Bacillus licheniformis
MPVHFFDAIVLDILSSMKGERSPSAVYHLLKGKRSSQTIQDAGLFAVSKYFGFCSALSREQVAASVQRLKQESLVREKAESGAYTVTEKGEAELAGFFALYPWPRHFHGGYYQAAAKVMWARMSLLIQVLSNKLYRERVYLPIVKDYQIQNWVKQYLRNRNAAETAAQFHQELKEKLSVLNHDEQAAIFVHSLTSRTKAGYTFRQLSEKMNLDEWYIYALFWDVLHHFIQSAQNGESPLFQTLIHDIPLNDGLTQSTRKTLFLIKEGYTIDRIAKIRKLKLATIEDHIVEIAIHDPSFSIDQYVSKEEQKIIADYAIANQTNKIRQIKEGLGGRYSYFKIRLALSKTVIRNG

SEQ ID NO: 6537 - protein, 82 aa, Bacillus licheniformis
MPKYTIVDKDTCIACGACGAAAPDIYDYDDEGIAFVTLDDNQGVVEVPDVLEEDMMDAFEGCPTDSIKVADEPFEGDPLKHE

SEQ ID NO: 6538 - protein, 192 aa, Bacillus licheniformis
MKHNKVRRLVSISMLSSIAFILMMLSFPILGAFPYLKIDFSDIPALLAVILYGPGAGIAVEAIKNVLNYFIAGSASGVPIDQAANFIAGTLFILPAAVLLKKSSSAKGFVTALFAGTLVMAVSMSILNYLLFLPAYTWFLNAPALTGEALKTTVLAGILPFNFIKGIAVALVSTPIFLSLKPRLKENVRMAK

SEQ ID NO: 6539 - protein, 12 aa, Bacillus licheniformis
MKFPTGGDEQAL

SEQ ID NO: 6540 - protein, 525 aa, Bacillus licheniformis
MFRVLVSDKMSSDGLKPLMEADFIEIVEKNVAEAEDELHTFDALLVRSATKVTEELFKKMTSLKIVARAGVGVDNIDIDEATKHGVIVVNAPNGNTISTAEHTFAMFSALMRHIPQANISVKSREWNRSAYVGSELYGKTLGIIGMGRIGSEIASRAKAFGMTVHVFDPFLTQERASKLGVNANSFEEVLACADIITVHTPLTKETKGLLNKETIAKTKKGVRLVNCARGGIIDEAALLEALESGHVAGAALDVFEVEPPVDSKLIDHPLVVATPHLGASTKEAQLNVAAQVSEEVLQYAQGNPVMSAINLPAMTKDSFEKIQPYHQFANTIGNLVSQCMNEPVQDVAIQYEGSIAKLETSFITKSLLAGFLKPRVAATVNEVNAGTVAKERGISFSEKISSNESGYENCISVTVTGDVTTFSLRATYIPHFGGRIVALNGFDIDFYPAGHLVYIHHQDKPGAIGHVGRILGDHDINIATMQVGRKEKGGEAIMMLSFDRHLEDDILAELKNIPDIVSVKAIDLP

SEQ ID NO: 6541 - protein, 274 aa, Bacillus licheniformis
MKKLRHQNFLFAIAWLSGLALFVNAPGSEASEWIEPIKGEITDQFGTRGGKHKGLDIAAPEGEAVAAAADGTISKSYQSDSYGQVIFIKHDNGYETVYAHLSKRLKKEKERVKKGEQIGIIGITGISTGTHLHFEMHHGSWTEDKRYAINPLTVLREEAFRQNSIHVHQNAGTMSGAVTVQKGDTLWRISKDSGISIEEIMRINGLKHSNLKAGQTLRLHDDESKTGTYVVRKGDTLHHIAEKMGVTVQRLKEWNDLKGERIYPRQMLEIRENS

SEQ ID NO: 6542 - protein, 368 aa, Bacillus licheniformis
MKKSEWNEERLKALLSQLPTVKDNRSANQIYQKLILAPKRKSPKKRVGAFAATVLVLFLLMLITPQLIEQIRSQNSADANISSDGKLVQTEADAAKSEPANTFVVSQNQKDDYITFAFLDESKSVVVPVSLEKSTGMTNLEDALHAYSRLGVDQFTSFDTAYLDKVKFKEQKNNKKLKIQVDEKIPELSVEDFERLKNVINETFKWGSYDSVLFISNDKSGVEFETFGMLADMAIMHQTQKCYYLYESSDGRRFLAPSSESYESVQEAIKMMKNEESGTHLKPILSDDTPIEDIQKNGKELIIQFSSSANIENKPEDVLMVEGLLLTAKDFGFTKVKFKNASITKVGAYDLSKSVQVPYAPNPMTIEN

SEQ ID NO: 6543 - protein, 194 aa, Bacillus licheniformis
MEETFQKIYDQYHQDLFQFLFYMVKDKNQAEDLVQEVYIRVLHSYETFEGRSSEKTWLLSIARHVAIDWFRKQQTIRQRILGTFDWEKQDVKDRKPLPEDIVMQNENLKEIFEALDKCTLDQRSVIVLRFIQGYSISETAKALNFSESKVKTTQHRGLKVLRKQMELLKEDPKNEEVRMERRTAEGVTKPTSNG

SEQ ID NO: 6544 - protein, 304 aa, Bacillus licheniformis
MVKMRKGKLKMKNVILFVLALVITIGSVVSYGIYRTVAKSINGMYEPLHRDAEQKDTAPHDPISILLLGIDERPGDKGRPDSMIVMTVNPKTKKTTMTSIPRDTRVFIKSKNKFSKMNSAYTYGGIEGTVETVEQFLNIPINYYIKINMDGFKDIVDAIGGVTVDNRIDFTLEGVHLSKGKQHLDGKTALTYARMRKDDPRGDFGRQERQREIINEIIHEGAQLKSLTNYQEILAALEKNIKTNLTLDKMIDIQSSYKEAAKDIKQVEIEGEDKKVDSLWYHLVTDEKRMEISKKLRQQLDLKS

SEQ ID NO: 6545 - protein, 276 aa, Bacillus licheniformis
MSNSPKEDHKLSALGKLVLGMLIVFGVTLLCISWNALAGPKQEPIKENSAASASVPGGKHKAEKKESKQTAPEIGKVVYLSFDDGPNPAASDKILSLLDKYHAKATFFMLKPNIEQNPDIVKKMVENGHSVGSHGVTHQVSKIYKSPESFAAEMNDTLKAIKETTNVDTHLIRSPYGSKPYITGPFQEVIKRDHFNLWDWTVDSEDWKSANTNGQFVNNVIQQVNNLSGVEPLVVLMHEKPTTAAHLEKLLKYFQENGYEMKPIHDSIKPVHFRWN

SEQ ID NO: 6546 - protein, 376 aa, Bacillus licheniformis
MKNKPFIIWAGVLLFLIIIVSSYNVGKRSETIIIPSGEENHIYDQKTRPFQVNTIYRLPKVGQLLGWSSPDSVVGFFKGEGTSERTAHSLQRLSSPYEKAEIVKGIESNTSNLKMSPDGKRIAGVTLSLSKASMQLFSPASGKKTEIASTSASSEVYVQDVSWSNNSRYVCYLVLDVGQGDETGLRVYDTASGTLKTYSLNDFAEKDSLTGVNISDNGRDLLFTVLQRSDEYGIRMGTIDGSRIKIEDKRLDSRGGPVWLNNDQFVFLDTGETLCEYDRRNGELSALLDKVTVFKFSNDFKKIAYSLKDEDNIYAGKLQGKNILYEEPIYHGTIPSEIFWSPDGNSLLVNAQYQYPAMESASVRFLEEQAYIITFK

SEQ ID NO: 6547 - protein, 483 aa, Bacillus licheniformis
MLRTIKGKFIVGFFLIFSLSFLVLNHTVKNVIWSSNEKIVTSDLVELKKNSTVYVNQAFLINHYKNNELYFGDMADEMVDNLNHSTGSNVGVYTVDGALLSSSDQKVFSRGSDEDLQQAIKGKTAYHITYNRNKAKVFFSYPVVIEGTKVGILRFSKNFDLLYKQSGEILDIVFYIALAIFVAAFLFSYILSRHITIPLVKLTDATSQVKKGKLDMDIHFNRKDEIGQLAVNFNDMISRIREQILTIERDRDRLKELNEQEKRFFDNMTHELKTPLTSIQGYAEIIKDKGEADRKFFDKGMNHIVEESRRLHNLVIKLLEVSRETSKSAQFDRIDAGEILKDVCESMKFRAERYKKRITCDIEDGLYVLGEVSRLRQLFINLLDNAIKYSLSHSEIIIKAEIVGENILFTFKNPSDPLENDQHTKMFQPFYSVNQKIKEEGSVGLGLSIVKTIVDEHGGTIEMFYKENHTVIQVELAYAKVEK

SEQ ID NO: 6548 - protein, 233 aa, Bacillus licheniformis
MEKTKILIIEDDEAIADLLSYGLTSEGFETCTVNNGSSGMRKLDQFKPDLLLLDWMLPDCSGLDICKKVTESCNIPILMITAKSDITDKILGLEFGADDYITKPFDLREVVARIRTILRRLEQAHHVNERETEKVDEIRFKNIVIVPGERLVKKDGAAVELTPKEYDLLMTLVDHRGKVFTRSELLEFIWGYDFFGDTRTVDTHIQRLRKKLDASDLIKTVFGIGYKFEKQEE

SEQ ID NO: 6549 - protein, 593 aa, Bacillus licheniformis
MKFWKSVVGKLWFTILLLVSFVLFILTFFLLEFIENYHVDEAEADLTKLASKVAVIMENHKDQETARSITWELADELTSIAVIKNENEYWYSPREHQKVASITLKDIKNDPDLNEALRKHQKVQKRTVISNQKNDQLIVGVPYGKGEDEGMVFLSQSLLAVKDTTQHTTRYILFAAAIAIVLTTIFAFFLSSRITYPLRKMRQGAQDLAKGKFDTKIPILTQDEIGELAIAFNQMGRQLKFHITALNQEKEHLSNILSSMADGVITINIDGTILVTNPPAERFLQAWYYEQNMNVKEGHELPPEARELFQNTVSTEKEQMIEMTLQGRTWVLLMSPLYNQSHVRGAVAVLRDMTEERRLDKLRKDFIANVSHELRTPISMLQGYSEAIVDDIASSEEEKKEIAQVIYDESLRMGRLVNDLLDLARMEAGHISLNVEPVELREFFERVFRKFYGVAGDKNITLSHNLDLHEAKFVFDPDKMEQVLTNLIDNAIRHTNAGGTVHVDVQSAESGLKIAVKDSGSGIPEEDLPFIFERFYKADKARTRGKGGTGLGLAIVKNIVDAHNGSITVHSMLNEGTSFTFYIPRNKQDDGQI

SEQ ID NO: 6550 - protein, 240 aa, Bacillus licheniformis
MEQTKETKILVVDDEARIRRLLKMYLERENYKIEEAENGDEAIDKALGNDYDLILLDLMMPGTDGIEVCRQVRDKKATPIIMLTAKGEEANRVQGFEVGTDDYIVKPFSPREVVLRVKALLRRSSQTSYLNTDTTAKNVLVFSHLSIDHDAHRVMADGTEVSLTPKEYELLYFLAKTPDKVYDREKLLKEVWQYEFFGDLRTVDTHVKRLREKLNKVSPKAAKKIVTVWGVGYKFEVGNE

SEQ ID NO: 6551 - protein, 391 aa, Bacillus licheniformis
MAELSGNLLYAAFLLYLSAVFFFGGSIRSKASDRKKKNRWASIAVLITIIGFVCQFGYFIARWIVSGHAPVSNLFEFTTAFSMMLVLAFIIIYFIYKLSALGLFTLPVVLLLIAYASMFPTDITPLIPSLQSNWLYIHVTTAALGQAILAISFVAGVIFLLKHVDHSKPGKKTFWLECVMFMLVTTLAFILVTTSFRIGGYEAQFKWIDKDNQEDVMIYELPALIGPNKGELLTEERMEPLVNVPPIFSGRKLNTVLWSFGTGALLYGVIRLIIRKRISQLLQPLVKNVNLDLVDEIGYRSVSIGFPVFTLGALIFAMIWAQLAWSRFWGWDPKEVWALITFLFYAAYLHLRLSRGWHGEKSAWLAVIGFAIIMFNLIFVNLVIAGLHSYA

SEQ ID NO: 6552 - protein, 542 aa, Bacillus licheniformis
MKEIKCECGHVNPAGTVLCESCGKPLVKQDAKLLDMRYDGSARRSQTYNKTIVDKIWNFFSSVKVGVWLIVITLTASAFGTIFPQEMFLPPGAQADTYYSEQYGLLGQIYYALGFHNLYGSWWFIILVASIGISLVICSLDRVVPLYRALKNQGVTRNPNFMERQRLFSRTEADMSEDTKSQIIGKLKKKRYRVKEENGNLFAEKGRFSRWGPYVNHIGLIIFLIGVMLRFVPGMYVDETLWIREGETVPIPGTDGHYYLKNNRFIKEMYDSEKEKEVFSEAITKAGDGTVAKTYQTDVELYERKNDSLPGEAPELKKVKNGKIKVNDPLKFGSYALYQLTYKEGELDKMVFQLIEKDSGKSFGKVAIDLLEPKPEYDLGNGYKVHIASYLPDFYFNKDGEPSTKTRNPNNPAFVFQITAPDKPKGEKSFVAIQETIEGSDDNKYKMKFDHVETKNLSGLTIRKDLTLWVLMVGGAIFMIGVIQGMYWHHRRIWLRTLDGHVLVAGHTNKNWYGLKQDLKAALADTGISEPADQKELSKEKK

SEQ ID NO: 6553 - protein, 177 aa, Bacillus licheniformis
MKKKRFYIRTGILLVLLAALGYTLYSAVFQNTESVAVGEKAPIFSLEDVDGNRLKLDELKGKGVFLNFWGTWCEPCKREFPYMANQYKVFKDKGVEIVAVNVGESNLAVRNFMKDHGVNFPVVLDKDRQVLNAYDVTPLPTTFLINPDGEIVKVVTGEMTERMIHDYMNMIKPEGSS

SEQ ID NO: 6554 - protein, 260 aa, Bacillus licheniformis
MFVGLEKSKIIHEVKDMERLQKVIAHAGIASRRKAEELIKEGRVTVNGKTVRELGVKVSSSDRIEVNGVQLESEEPVYFLLYKPRGVISAVKDDKGRKVVTDFFTEVEERIYPIGRLDYDTSGLLLLTNDGDFANKLMHPKYEINKTYVAKLKGIPLKENLKKLERGVRLEDGKTAPAKVKLLSLDKKKQTSIVQITIHEGRNRQVRRMFEAIGHEVLKLKREEYAFLNLAGLKTGEKRELTPHEVKRLRALAEHGKAAF

SEQ ID NO: 6555 - protein, 178 aa, Bacillus licheniformis
MEFINWLSLALIPFIIATILLYGTFKKVPTYEAFVEGGKEGIQIAFSIIPYLVGMLVAITVFRASGALDFFMNLLKPVFSAVGIPTEVVPLALIRPISGTAALGMTTDLIAVYGPDSFIGRLASVMQGSTDTTLYVLTVYFGAVGIKKMGDALKVGLLADLAGVIASVIIVTLLFGSA

SEQ ID NO: 6556 - protein, 195 aa, Bacillus licheniformis
MVNIIWVGLTVIGLVFALFNGTVQEVNEAVFKGSKEAVTIVIGLMSVLVFWLGLMKIAEQSGLLEKFSRLCRPFISKLFPEIPPDHPAMGYILSNLMANFFGLGNAATPLGIKAMEQMKALNRNRREASRSMITFLAVNTSSITLIPTTVIAVRMTYDAKAPTDIVGPTILATLISGIFAIFIDRYFYYRRKKKG

SEQ ID NO: 6557 - protein, 384 aa, Bacillus licheniformis
MRFFLKQAAAAIMICSLLCSSYETAQAQPSLHISAKSAIVMDGQSGRVLFAKDEHEKRRIASITKIMTAILAVESGKLDETVTVSDRAVRTEGSSIYLTSGQKVKLKDLVYGLMLRSGNDAAVAIAEHVGGSLEGFVYMMNQKAAELGMENTLFRNPHGLDDHPDHYSSAYDMALLTKYAMTNETYKKIAGTKRYKAETMQGIWRNKNKLLTGLYKYSTGGKTGYTKLAKRTLVSTSSKDGTDLIAVTINAPDDWNDHMNMFNYVFGHYKTYIIAKKGEIPKLKDSFYGNKAFIKRDVTYLLNEEEKEDVKVDIELLEPKKSWRKNKKEIPDIIGEMNVMFDGKTIASVPIYYENERNKKPKKSFFETFQSVFQKAAGGSSWSI

SEQ ID NO: 6558 - protein, 163 aa, Bacillus licheniformis
MGKSMARAQTEQAGEFLAQTVQTLCDYLNETTLSSLEAEEPGRRDYYRDVLSNLRKLAVYCEEGLAACRIRLQQDPFQEAAAERTLYQVYHRCIEEFFTPKKDTWYEDSRAAYTGKNAICFHEPAPASLKNLMASLETGYQSMREELEYYATDYRMKMVQPRS

SEQ ID NO: 6559 - protein, 197 aa, Bacillus licheniformis
MTLDIVNWKAIVEALLYAAGDEGLTKKQLLSVLEVDEAELLDIMLDVKETYEKEDRGIELVEYADTYMLSTKKEFAVYLKKLIEAPSKGLSQAALEVLAIVSYKQPITRAEVEEIRGVKSERILQSLVAKALLCEVGRADGPGRAILYGTTETFLEQFGLKTLEELPPLPENVEEDGVQEEADLFFENFNQTFEDLK

SEQ ID NO: 6560 - protein, 251 aa, Bacillus licheniformis
MEYQVKIEAFEGPLDLLLHLINRLEIDIYDIPVAKITEQYLLYVHTMRELELDVASEYLVMAATLLSIKSRMLLPKQEEELFDEEFLEEEEDPREELIEKLIEYRKYKSAAQNLKEREEERQKAFAKPPSDLSDYAKEIKLSEQKLSVTVYDMLGAFQKVLNRKKINRPSETRISRQEIPIEERMTQIVDCLKSSRKRMHFMELFPYEQKEHLVVTFLAILELMKNQLIIIEQEHNFSDIYITGSEAIHDA

SEQ ID NO: 6561 - protein, 31 aa, Bacillus licheniformis
MGGKGFGYGGGFALIVVLFILLIIVGAAWIY

SEQ ID NO: 6562 - protein, 173 aa, Bacillus licheniformis
MYPQAYIDYLAEFHGARDYFECHEILEDHWKKDPPGERKLHWVGLIQLAVALYHQRRNNFAGAERLMANSIRILASEKDAVESLGLDYSRFIELLRRTHQKIEAHSPYESIMLPIADEALIKACRKQCEKKSYEWGANAAPDAFIIDKHRLRDRTEVIAERDKQIKRRKKSRG

SEQ ID NO: 6563 - protein, 124 aa, Bacillus licheniformis
MLIRYKKSFEKIAMGLLSFMPNEKDVKQLQQTIKDYETDTERQLFLWKEGEDIVGCVGVEKREEEVEIKHISVNPSHRHQGIGKKMVSAISPIFAPKPLVPNELTKGFFERCQDHENEDITYNQ

SEQ ID NO: 6564 - protein, 154 aa, Bacillus licheniformis
MNKIEGHVIGTDLKIGIVVSRFNDFITSKLLSGAEDTLLRHGVKADDIDVAWVPGAFEIPLIAKKMAETKKYDAVITLGTVIRGATSHYDYVCNEAAKGIAASSMSTGVPVIFGVLTTDTIEQAVERAGTKAGNKGAEAAAAAIEMANLTRSLQ

SEQ ID NO: 6565 - protein, 398 aa, Bacillus licheniformis
MFHTIEEAIRDLKQGKVIIVVDDENRENEGDFVALAEYATPDVINFMASHGRGLICAPLNEEIASRLELQPMVDENTDSHHTAFTVSVDHRDTKTGISAQERSLTVMSLIADHAHPGDFKRPGHIFPLIAKKGGVLKRAGHTEAAVDLAEACGSAPAGVICEIMNEDGTMARVPELKKIADQHGLKMITIKDLIEYRYSKGTLINREVKITLPSEFGTFKVYGYTNEIDDKEHIALVKGDIPFGDEPVLVRVHSECLTGDVFGSYRCDCGPQLAAALAQIEQAGRGVLLYLRQEGRGIGLINKLKAYKLQEEGYDTVQANEKLGFLPDLRNYGIGAQILRDLGVKQMKLLTNNPRKIAGLEGYGLTIADRVPLQMETKKDNEKYLKTKKSKLGHMLHF

SEQ ID NO: 6566 - protein, 215 aa, Bacillus licheniformis
MFTGIIEEVGTILDMKKAGSAMSLVIQSNKVIEDVKLGDSIAVNGVCLTVNEFGSSSFTADVMLETLKATSLGTLKKGSRVNLERAMAANGRFGGHMVSGHVDGTASIVRIEKAANTVYYDLKLDPSLAKMLVLKGSIAVDGVSLTIFGLTEDQVTVSLIPHTLDETIFPAKKVGSIVNIECDMIGKYIYRFLHQTKQEKQAQALTEAFFKENGF

SEQ ID NO: 6567 - protein, 362 aa, Bacillus licheniformis
MTDAHYMNLALELARQGEGQTGANPLVGAVVVKDGEVVGMGAHLKYGEAHAEVHAIQMAGRHAEGAVIYVTLEPCSHYGKTPPCAELIIRSGLKRVVVAAEDPNPLVSGRGIEMLRSAGIEVETGVLKEQAEELNEKFMHFMRTGLPYVTLKAAASLDGKTATATGDSKWITSEEARMDAHQYRKNHQCILVGSGTIKADDPSLTCRLPGAVNQPVRVVLDTTLSIPLQSKVIQDKEAPTWIYTTSKADPEKVRNVEKEGVQVTVLDADELQVRDVLLHLADRGIASVFVEGGATVHASFVKEGLYQQIIFYLAPKLIGGLQSPSILSGEGFQSMKDVPLLQFTTITKIGQDIKLAARPIKE

SEQ ID NO: 6568 - protein, 114 aa, Bacillus licheniformis
MGKIKFKLTVLLVLAAVLAGGFYYLKNGSVQDVSTALSQTVSSEEKNYTIYQYKITKIDGTEYHGVSDNGTKIIFNAKNLNQDLSDIKEGDKVKAYFSNANRIDGLIKVVKVAE

SEQ ID NO: 6569 - protein, 728 aa, Bacillus licheniformis
MRTLVLLRGCPGTGKSTWIRDHQLNQYTLSADQLRLIHQSPVLNLEGKYDISQKNDGKVWKLLFSLLEERMERGEFTIVDATHAKQSMISGYKALVLKYRYRAYVVDFPNVPLETALLRNRERAEHKRVPDSVVHAMHERILSEPAPSWTTVIKPEEFADAMQYKPRRLDSYKKIHVIGDVHGCFTVLDSYLKGRLEDDELYIFTGDMVDRGIENAKVVQFLLRIKDRKNVILLEGNHDKYLKQYGHDEVTRSSVFNKKTKPELDEAGFDKRDIRELARRFHQIAYFTYGQDTYIITHGGISALPDNLLFTATSQLINGVGGYETDIDHVFTKNMEGRNIIQIHGHRNMFRLPVHAAAKSYNLEGQVEHGGHLRVVTIDRSGIQTHEIKNDVFKTSAPPLTSHHAHEELTVEHFLKHLDEHDYVSEQKLAGGISSFNFTRKAFQERKWDSVSMKARGLFINRNTNEIVSRSYNKFFNIEERLTTKMHVLVNTLRFPVTVYDKANGFLGTVGYNSETDELVFTSKSYTSSGQKDGHAKWVEELFYKTFDASQTEAMKEYVKKRNVSLVFEVVLPEKDPHIIEYESDKLVLLDIVKRQMKYEKLLYEDVLRFAETFRVECKQKVITFHQWTDFYKWYLSVSNDPSIEEEGYVIEDSAGFMTKLKLPFYQYWKFIRGIKHRLGAAAARSPQHEALFHSEHVKFLAWAKTKDSEYFKNQSVIAIRNDFYNET

SEQ ID NO: 6570 - protein, 145 aa, Bacillus licheniformis
MPLVPYEPFKHLNTIRREFDRVFADFPANFGGEHGFGDIRVDVHEAGNEIVASCDIPGLESKEDVHIEVENNMLHISGTINRSSEVKEENMHRKERFTGRFHRAVALPAPVSREGIRASYRNGVLEVRMPKDKPDEKKRIDVEFH

SEQ ID NO: 6571 - protein, 376 aa, Bacillus licheniformis
MSVKIPSTAVGVKINDWYNAIRKFNVTDAEMLKAEIEREISQMEEDQDLLLYYALMEFRHRIMLDYVKPLEEGETPPDFSEILKDIEDEQGKLTGLLEYYFNFFRGMYEYKNHDYIKAISFYRRAEKKLLHVEDEIERAEFHFKMAEVFYHMKQSHVSMNYALQAIETYQAHETYTVRRIQCEFVIAGNYDDLESNEKALSHLEKALKLSQQEGQLILEGHTYYNLGNCYYKMGDFDQAAEYFNRAAAIYQEESSDILPKAFFSLALAYFKLKQLEKADDALNKGIDIARRSDDAIYLSKFHFLKALYVDDDGRAPMLETFQLLGSKKMYPDIEDLALEAAEYYNEIGRLSDSVYFYQTVFSARKQMKKGDWSYEI

SEQ ID NO: 6572 - protein, 145 aa, Bacillus licheniformis
MAKKGYIQLTNGKKIEFELYPDAAPGTVANFEKLANEGFYDGLKFHRVIPGFVSQGGCPHGTGTGGPGYTIKCETEGNPHKHEAGSLSMAHAGKDTGGSQFFIVHEPQPHLNGVHTVFGKVTSGLDAVTSMEQGQGMEKVEVFDA

SEQ ID NO: 6573 - protein, 298 aa, Bacillus licheniformis
MKKSILGIFTALCLLIFPQVSFADAAVGDVIVTLGKDLSSQDRQKVLKEMNAPENATIIEVTNDEEHKYLGDYIPKAQIGTRAISSSSITVAKKGTGLEVQTHNISRITDEMYLNALMTAGVKDAKVYVTAPFEVSGTAALTGLMKAYETTSGEKISEDVKKVANEELVTTSELGEKIGSENASALMAKVKEEISKNGVPESKEELEKTIDSAASELGVTLTEDQKNSLISLFNNMKNINIDWNQVGDQLDKAKDKITKFLDSEEGQNFLQKLIDFFVSLWNAIVSVFTGGGTSESNG

SEQ ID NO: 6574 - protein, 110 aa, Bacillus licheniformis; identical to SEQ ID NO: 4682

SEQ ID NO: 6575 - protein, 286 aa, Bacillus licheniformis; identical to SEQ ID NO: 4681

SEQ ID NO: 6576 - protein, 243 aa, Bacillus licheniformis
MNILLISAVISFPYSAAAHGATQSGDQYSSFEELERNEDPASYRITEKNARVPMLIMAIHGGGIEPGTSEIANEVSKNYSLYLFEGLKSSGNTDLHITSTRFDEPAALAITASHQYVMSLHGYYSEDRDIKVGGTDRAKIRILVDELNRSGFAAEMLGTDDKYAGTHPNNIANKSLSGLSIQLEMSTGFRKSLFDRFTLKDRAATQNETFYRFTKLLTDFIHENYEEDGGDFPSAKIKHPLQV

SEQ ID NO: 6577 - protein, 439 aa, Bacillus licheniformis
MFLHGTSRQNERGHLEIGGVDVLSLAERYGTPLYVYDVALIRERARKFQKAFKEAGLKAQVAYASKAFSSVAMIQLAEQEGLSLDVVSGGELFTAIKAGFPAERIHFHGNNKSPEELAMALEHQIGCIVLDNFHEIAITEDLCKRSGQTVDVLLRITPGVEAHTHDYITTGQEDSKFGFDLHNGQVEQAIEQVLRSSAFKLLGVHCHIGSQIFDTAGFVLAADKIFEKLAEWRETYSFIPEVLNLGGGFGIRYTKDDEPLAADVYVEKIIEAVKANAEHFGFDIPEIWIEPGRSLVGDAGTTLYTIGSQKEVPGIRKYVAIDGGMSDNIRPALYEAKYEAAVANRMNDACHDTASIAGKCCESGDMLIWDLEIPEVRDGDVLAVFCTGAYGYSMANNYNRIPRPAVVFVEDGEAQLVIQRETYEDIVKLDLPLKSKVKQ

SEQ ID NO: 6578 - protein, 109 aa, Bacillus licheniformis
MYPNRYPYTPAPGYAPEDVYAPYQPAAHYEQRIYEPYEGQIITAPANTRFWRRGTEVFLHSSTIDPYGREMLYVVYPIRRQNNICSLRAVAISANEYRGIGTQRPEFDY

SEQ ID NO: 6579 - protein, 490 aa, Bacillus licheniformis
MSAQKQEKTNVFLDPSKNEAYFKKRVGMGESFDLGVRKVFILGHEVQLYYVNGLCDTQYIIHLLRELVHLNDKEKESGEVEDIVENRLLNQQVSKAETLDEAVDQVLSGLVAIIVEDAGFAFIIDVRSYPGRTPEEPDTEKVVRGARDGLVENIIVNTALIRRRIRDERLRYKMLHIGERSKTDICLCYLEDVADPDLVEVLKKEIEDVKIDGLPMSDKSVEEFLVGQGYNPFPLVRFTERADVAASHILEGHVIVIVDTSPSVIITPTTLFHHVQHAEEYRQTPAVGTFLRWVRFFGILASTFLLPLWLLFVIHPSLLPDNLSFIGLNKDTHIPIIMQIFLADLGVEFLRMAAIHTPTALSTAMGLIAAVLIGDIAINVGLFSPEVILYVSLSAIGAYTTPSYELSLANKMVKLFMLILVALFKVEGFVIGLTILTIVMTSIRSLRTPYLWPLLPFNGKAFWHVLVRTSVPGGKVRPSIVHPRNRSRQP

SEQ ID NO: 6580 - protein, 200 aa, Bacillus licheniformis
MPAKRKVILVTDGDIYAAKAIEYAARKTGGRCISQSAGNPSVKTGPELVTMILQTPHDPVFVMFDDSGLQGEGPGETAMKYVAMHPDIEVLGVIAVASKTHYAEWTRVDVSIDAEGELTEYGVDKHGVKEFDVKRMNGDTVYCLDQLDVPIIVGIGDIGKMNRKDDVEKGSPITMKAVELILERSGYHECSKAREDERIP

SEQ ID NO: 6581 - protein, 116 aa, Bacillus licheniformis
MEYVIAFIAGGLICVIGQLLLDIFKMTPAHVMSTFVVSGAILDGFGIYDRFIEFAGAGATVPIVSFGHSLLHGAMHQAEKHGFIGIGMGIFELTSAGISAAILFAFLVAVIFKPKG

SEQ ID NO: 6582 - protein, 339 aa, Bacillus licheniformis
MKLTGKQTWEFENPLFVNSSGTAVGPKEKEGPLGHLFDKSYDEMHCNQKNWEMAERKLMEDAVQSALSKQNLKKEDIDIFLAGDLLNQNVTANYVARHLKIPFLCLFGACSTSMESIAISSALIDGGFAKRALAATSSHNATAERQFRYPTEYGGQKPGTATSTVTGSGAVVLSQQPGGIKITSATVGRVIDLGITDSQDMGSAMAPAAADTIKQHLEDLGRTPDDYDLILTGDLSGVGSPILKDLLKEEGINVGTKHNDCGLMIYTPDQQVFAGGSGCACSAVVTFAHIFKEIEAGRLNRVLVVATGALLSPTIIQQKESIPCIAHGVVFERAERGNA

SEQ ID NO: 6583 - protein, 149 aa, Bacillus licheniformis
MSSLKDNYQSKVKAYQPSPPYVLNCIKAFLVGGLICTIGQAFQNFYMAVFHFDEKTAGNPTVATLILISALLTGLGVYDRIGQFAGAGSAVPVTGFANSMTSAALEHKSESYVLGVGTNMFKLAGNVIVFGVVAAYIVGMIRFAFDKLF

SEQ ID NO: 6584 - protein, 141 aa, Bacillus licheniformis
MIISVIFIIFLGLAGGVAVGSGFVAFLTVLGIIPRLTQLTKTKGFIQAYEWAVILGAVFGGWESLNMSRFFLSKWLLVPIGLFAGVFIGMLAAALTEVLNVLPILAKRIGMGDRILILLMAIVFGKILGSMFQWLIFVHLS

SEQ ID NO: 6585 - protein, 206 aa, Bacillus licheniformis
MERQVFIRLRHRLEADPDELILLGHIAQVAGDRGYKEKLERLPIYQVSKADQSMVVLDVMKVIEAVHKSFPDLDVQTVGGSETIVEIQYPKRDLSPVLFIAVWLLLFVGAGLAVMNFHEDVSMREVHILLYEMVTGKVNRYPYLLQVPYSIGLGLGMILFFNHLFKKRFNEEPSPLEVEMFKYQLDLDHYVAMHENKETTKDIHDH

SEQ ID NO: 6586 - protein, 255 aa, Bacillus licheniformis
MDVEVKKENQNTQLKDHEVKELIKNSQNGDQKARDLLIEKNMRLVWSVVQRFLNRGYEPDDLFQIGCIGLLKSVDKFDLSYDVRFSTYAVPMIIGEIQRFIRDDGTVKVSRSLKELGNKIRRAKDELSKSNGRIPTVQEIADYLEISSEEVVMAQEAVRSPSSIHETVYENDGDPITLLDQIADQSEEKWFDKIALKEAIKDLDEREKLIVYLRYYKDKTQSEVADRLGISQVQVSRLEKKILKQIKNQMDHFES

SEQ ID NO: 6587 - protein, 146 aa, Bacillus licheniformis
MKNEMNIQFTALSQNESFARVTVAAFIAQLDPTMDELTEIKTVVSEAVTNAIIHGYENSGQGNVYISVTLEDHIVYLTIRDEGVGIPNLEEARQPLFTTKPELERSGMGFTIMENFMDDISIDSSPEMGTTIHLTKHLSKSKALCN

SEQ ID NO: 6588 - protein, 117 aa, Bacillus licheniformis
MSLGIDIHVKESVLCIRLTGELDHHTAETLRKQVSDHLEQTDIRHIVMNLADLSFMDSSGLGVVLGRYKEIKQLGGEMIVCAISPAVKRLFDMSGLFKIIRLEQSEQRALETLGVAS

SEQ ID NO: 6589 - protein, 395 aa, Bacillus licheniformis
MEVWVMKRHLSKLLIFTIILMTAPSALAKESAKKPSELADDAKSAVLIERDTGKVMYDKNSREKLPPASMTKVMTMLLIMEALDEGKIKMKDKVRTSEYAASMGGSQIFLEPGEEMTVEDMLKGIAIGSGNDASVAMAEHIAGSEEEFVKRMNEKAAELGLKDTSFQNTTGLPEEGHYSTAYDMALMAKELLKYENITKFTGTYEDYLRENTDKKFWLVNTNRLIKFYPGVDGVKTGFTNEAKYCLTASAKKGNMRVIAVVFGASTPKERNAQITKMLDFAFSQYETHPMYKRNEIISDLKVNKGREQKINLVTSEPISLLTKKGENIESVKKEIKQKEDIQAPVKKGTELGTLVLKKDGKVLAESPLVAEKDMDKAGMWTMFKRTMTHWTKWSE

SEQ ID NO: 6590 - protein, 271 aa, Bacillus licheniformis
MKQMIANAADYIKSKTEIKPAVGLILGSGLGVLADEIEDAVRIKYEDIPDFPVSTVEGHAGQLVIGRLENVQVVAMQGRFHFYEGYSMDKVTFPVRVMKELGIETLIVTNAAGGVNESFRPGDLMIISDHINYMGTNPLIGPNDSSLGVRFPDMSSAYDKELRLLAKKTAEELNISVQEGVYTAVTGPTYETPAEVRFLRTIGSDAVGMSTVPEVIVAKHAGLRVLGISCISNAAAGILDQPLSHDEVIEVTEKVKADFLRFVKAAVAKIG

SEQ ID NO: 6591 - protein, 394 aa, Bacillus licheniformis
MPAFDYNRVFLIVMDSVGIGEAPDAEKFNDKGADTLGHIAEHMGGISLPNMAKLGLSNIREIKGVEKAEKPLAYYGKMKEASNGKDTMTGHWEIMGLYIDKPFRVFPEGFPDELIHELEQKSGRKVIGNKPASGTAILDELGAEHMETGALIVYTSADSVLQIAAHEEVVPLEELYKICEIARELTLDEKYMVGRVIARPFVGKPGEFKRTPNRHDYALKPFDRTVMNELKDDSFDVIAIGKISDIYDGEGITESLRTKSNMDGMDKLVQTLDKGFTGISFVNLVDFDALFGHRRDPEGYGKALEEFDARLPEVFEKMREDDLLIITADHGNDPVHHGTDHTREYVPLLVYSKKHEKPGALPLADTFADIGATIADNFKTNMPKYGKSFLSLLK

SEQ ID NO: 6592 - protein, 296 aa, Bacillus licheniformis
MKVHIKDFIHYAVVERGLSHNTVVSYERDLNSYAAYLEEQEQLSSFDQVTRLHIIQFLKHLKDAGKSGKTVARHLASIRSFHQFLLREKVTAQDPSVHIESQKTERTLPKVLSLQEVETLLDTPKLTGPFGYRDKAMLELLYATGIRVSEMIALKLSDVHLSMGFIRCFGKGRKERIVPLGEAASHAVGEYLSKARGKLLKKNTEDALFLNHHGRQMSRQGFWKNLKKIALEAGINKELTPHTLRHSFATHLLENGADLRAVQEMLGHADISTTQIYTHVTKTRLKDVYRQYHPRA

SEQ ID NO: 6593 - protein, 74 aa, Bacillus licheniformis
MKMLKTAADMIKVFVLFTGFTVLFYYAMIWINSEYENYHRYDKPEGAALKVASMEEDEQGSWFNRLIFFYLNGE

SEQ ID NO: 6594 - protein, 149 aa, Bacillus licheniformis
METRIDRIKKQLHSSSYKLTPQREATVRVLLENEEDHLSAEDVYLLVKEKSPEIGLATVYRTLELLTELKVVDKINFGDGVSRYDLRKEGAAHFHHHLVCMECGSVVEIEEDLLEDVEEIIEKDWKFKIKDHRLTFHGICHDCQQKESE

SEQ ID NO: 6595 - protein, 218 aa, Bacillus licheniformis
MRKPTIKELIFQHMKDHLSIYLFVSVLFLMGVIFGAVIVNSMTIGQKEDLFYYLNQFFGQLSEGKAASSKEMFLQSFLHNMKYLGLMWILGISIIGLPVIFIMVFLKGIVVGFTVGFLVNQMGINGFFLSFVSVLPQNILLIPAYLIMGTCAIAFSMRLIRQLFVKRSLAEAPVHWFGRYAFVLVLILAMSLISSFFEAYLSPVLMEKLTEYVLPKQH

SEQ ID NO: 6596 - protein, 448 aa, Bacillus licheniformis
MSGFMEKFERNVERFLVPVAAKLNSQRHICAIRDAFILSFPIIMAGSIIILLNFAILSPDGFIAKILFLEKIFPNLADYQSVFTPVLRGSLDIMSIFVVFLVARNLAISMKADELLAGLTAVSCYFIIYSPYRLIENESFLTTKWLGAQGLFVALIIGIIVGEVFSRLSNAKRLQIHMPPQVPPAVARTFKVLFPIIFITIGFAILSFALMSLSKNGLHELVYTVLQAPLREMGTNIFTVVFLGIVANFLWLFGIHGPNTIAAIRETIFAEANLENLGFAAKTGSAWNAPFPETWALNDAFANYGGSGMTLGLLIAIFIASKRRDYKDIGKLSIGPGIFNINEPVIFGLPVVLNPIFMIPFIIVPAVNTVIGYLFIKFQLIPPIAYAVPWTTPGPLIPFLGTGGNWLALGVGFLCLAISTMIYLPFVMAANKTVNTDREHSAENRKES

SEQ ID NO: 6597 - protein, 99 aa, Bacillus licheniformis
MKKILLVCAAGMSTSLLVSRMKKHAEALNEEVDIIALPVSEAGTAASSADVVLLGPQVRYQKSQVEASAGDTPVQVIDMRDYGTMNGEAVLQKALQLMK

SEQ ID NO: 6598 - protein, 307 aa, Bacillus licheniformis
MKPVHQEKIQTDLTLSNSDLQPLKPEERTWKAVNFASIWMGCIHNIPTYATVGGLIAIGLSPWQVLGIIAVASIVLYAALALNGHAGAKYGVPFPVLIRSSFGIYGANIPALLRGFVAIMWFGIQAFAGSTAINILILNVWSGWKDIGGDWNLFGLHLPGLLSFVFFWGIHLLVLHHGMESIRRFEVWAGPLVYLVFGGMVWWAVDIAGGLGPIYSQPGKFQTFSELIWPFLAGVTGIIGIWATLILNIPDFTRFAASQKEQIRGQFYGLPGTFVLQASPSPPAHRLPSGSRFGTWSIFSPILTIRT

SEQ ID NO: 6599 - protein, 218 aa, Bacillus licheniformis
MQTGAEFDGQAFWITSPAVATFHEKHLREEYFMNPILLDFPDSFETERLLIRAPRAGDGKAVYDAIAASFSELKPWMPFAREIPEEERVEINVRRAQADFILRNDLRMHIFHKETGKFVGSTGLHRMDWKAKRFEIGYWRSSEFSGQGYMTEALNGLIDFARRHVRAKRLEICCDSMNTKSRKMAERLGFELEAVLQSDDLSNDLSEYRDTCIYSRIF

SEQ ID NO: 6600 - protein, 69 aa, Bacillus licheniformis
MAKSKARKKREHMLRNTGRDAAASRGKAPDFGTHVRKTKSRREELAKLHMKHKRKNPYDLLHEDHKGSF

SEQ ID NO: 6601 - protein, 150 aa, Bacillus licheniformis
MEWKLKSYEELSKEELYRIIKLRIDVFIVEQNCPYHELDHLDERAHHLFLSQEGEIAAYCRLFPSGTAYPEASIGRVIVRKEDRGKGYAQALLDKAIRFLEGEWEETKVKISAQNHLRSFYGSFGFKAISDVYMEDGIPHVDMVRTEETV

SEQ ID NO: 6602 - protein, 387 aa, Bacillus licheniformis
MKEIFADMHIHIGRTESGRPVKITAARTLTLDEILIEASEHKGMELIGIIDCHSPEVLAEIEKGVSSGRYTELEDGGIKYKDTVLLCGSELEINDDRCRGPIHVLAFMPSISAMKQFSGWLSERVTNIHLSSQRIYETGIGLQRKVKELGGLFIPAHIFTPHKSLYGKGVEFSLKEVFDPRMIDAVELGLSSDTDMASHVSELNPYAFLTNSDAHSLGKIGREYNKLHIKHASFQEFSLALKGQEGRSIAANYGMNPQLGKYFQTACETCGRLQEADETLCKACGSRKFTKGVSTRLMELYDQDESPVKRPPYVHQVPLQLIPGIGPKTIQKLKEAFGTEMNILHRVKEGDLKETIRPQTAELVIKARNGDLELKAGGGGTYGKVQS

SEQ ID NO: 6603 - protein, 188 aa, Bacillus licheniformis
MIKLKHLEEKTISKEKLFSGKVIDLYLEDVELPNGKTGKREIVKHPGAVAVLALTDEENIILVKQYRKALERTIVEIPAGKLEKGEKPEYTALRELEEETGYTAAKLEKITAFYTSPGFADELVHLYLAEELTPLEEKRELDEDEFVEVLEVPLSGALKLMETQDIYDAKTAYAVQYLELRKALQAKK

SEQ ID NO: 6604 - protein, 58 aa, Bacillus licheniformis
MKVYRLNDRIVMSGKAWEIRAKLKEYGRTHHYVKDWLSEKENRLQKLNFIDIKKGCMK

SEQ ID NO: 6605 - protein, 201 aa, Bacillus licheniformis
MGIEKGRKGKQSRKRLLEVAANEFANRGFHETKVSTIVKRAGLTQPSFYLYFPSKDAIYDELINGFHANLKNLIESFRLEKGIEKKHVSKRVTAAVEAVFRFLAEDPDLTRIGFFLSPEAGEMKKDLTLALKENLKAEQELGYFRSDLEMETVAECLTGMIEHLADIYLLDGSKDPSSLAKQITDLLIHGMLVNPQHPETE

SEQ ID NO: 6606 - protein, 115 aa, Bacillus licheniformis
MAFIFLKAGLAAFMLTGGVIKVLHVPFQVEHWRHYEYPLWFLSVTGCLEIAGALGMIGGIWNVHLAVGSGLLFSLLMTGAIHAHLVRARQPFFTAIPAAVCLICALSMIIVELYF

SEQ ID NO: 6607 - protein, 306 aa, Bacillus licheniformis
MKKRTLGHSDLQVSEVGLGCMSLGTDKKHALSILDEALELGINYLDTADLYDFGRNEEIVGEAIKSRRQDVILATKAGNRWEEGKPGWFWDPRKAYIKEAVKRSLKRLQTDYIDLYQLHGGTIEDNIDETIEAFEELKQEGVIRHYGISSIRPNVIKEYVKKSNIVTVMMQYSLLDRRPEEWLSLLEEHGISVIARGPLAKGILTEKPLSDANASIKKSGYLSYSYDELIKTKADIEKTAPDLSATETALKYILAQPAVGAVIPGASKLSQLRENVESVGGRSLTEQEIKALRFYTKRDVYTAHRE

SEQ ID NO: 6608 - protein, 77 aa, Bacillus licheniformis
MGKKKQDPNTRQLLKDALADDLKHKLQQMKSELKEEDEKRKEREKERLIKERQEREKNKSFEELLNESGLDDWRKYK

SEQ ID NO: 6609 - protein, 309 aa, Bacillus licheniformis
MLIWLAAIGAVLLFIAALGIYFTNQIMYIKKRTDQYIIERETADGHYDEKAFAALPKEEITLASSYGYNIKGYYVHPHKTKNTVIICHGVTMNLLNSIKYMNLFLDLGWNAVIYDHRRHGASGGKTTSYGYYEKNDLKTVVNWLREKHGEQALIGIHGESMGAVTTLLYAGMDDAEADFYVADCPFATFEDQLIYRLKEDFHLPGAFILPLASLFLRWRDGYRIRDVSPLSVVGKIKKPVLFIHSKHDDYIPAESSEILYEKKPGKKRLYIAERGAHAMSYTQNRNSYKNTVRDFLQEITNRHKEGERA

SEQ ID NO: 6610 - protein, 79 aa, Bacillus licheniformis
MNQKVKSLKQTAQNKTWASFLHQNHPYTLLHWSIGGTESVKKDVWLLQDEMTFETKEFDTIETAISWIGDHMSDITDIL

SEQ ID NO: 6611 - protein, 107 aa, Bacillus licheniformis
MQLEITAQARQAIQRATEPYPDKKIQLRYDSEGCGCAVSGVPVLWLTDELSGSCEPLETNGLPIYIQSSQKVFFDEAMTIDYYEKAGALMLKSPAQVLSPRMSILVK

SEQ ID NO: 6612 - protein, 65 aa, Bacillus licheniformis
MSKKVQIKVMDNGGFRVTGDVELIDMEGNPFPEKPAFSLCRCGKSLKMPYCDGSHKGMFDSCVRA

SEQ ID NO: 6613 - protein, 323 aa, Bacillus licheniformis
MIQLLNQKDPHTARSIVNVQRPAYEREAEIIQFQGIPQLNETVFDVMDSRETFIGSFEGEELAGIASFIHTAEKLTICRLAVHPVHFRKGIAMALLRYILMVKEAESFEVTTGAGNEPAKALYRKLGFSEIEQYEPEKGVVLSRLTLQAPRKVKVVSYKEEWKGEFFKEKKQLEALFRNEVLHIHHIGSTSIPGMSAKPIIDILIEVKDLGSAAGFEKGMKMLGYEPKGENGIPGRRFYQKGRRKRTHHVHLYESGHPDIRRHLAFRDYLISHPERAEEYAALKMKLAEMFPLDIAGYIDGKSGWIKETERLAEQWEKAEEDR

SEQ ID NO: 6614 - protein, 122 aa, Bacillus licheniformis
MISKTPEPPYYAVIFTSVRTNGDNGYKETAENMLKLAAEQPGFLGAESARDMNGKGITVSYWESLEAIEKWKFHGEHRQAKEKGRTEWYSDFAVRIAKVEDARISERSGRPPSDGTSGEEMQ

SEQ ID NO: 6615 - protein, 204 aa, Bacillus licheniformis
MRRHSFLSILLICMLSVVSVFSFRPSAASAASHNPVVMVHGIGGADYNFIGIKSYLQSQGWTSSELYAINFIDKTGNNINNAPRLSEYIKRVLNQTGASKVDIVAHSMGGANTLYYIKNLDGADKVGHVVTLGGANRLVTNTAPQNDKISYTSIYSTSDYIVLNSLSKLDGANNVQISGVSHVGLLFSSKVNALIKDGLTASGK

SEQ ID NO: 6616 - protein, 70 aa, Bacillus licheniformis
MMITVKIRHTAETEGTDIGDFTPAELESIVQTIRKYGAWLSPDADTDDYKFTFQDAKYNLEQRVFEIIVE

SEQ ID NO: 6617 - protein, 509 aa, Bacillus licheniformis
MAYIAKRMIIPIIFLFILASCSAGGAGSAKGEEKKLTFLFNIPSQTLDPNLDVNYTAIRAGISETLVKISADLSIEPWIAKDWKSKDGQTWVFTLKDNLTFQNGKKADAKAVKASLERTMRESKAMKNALKIKEIKAEGQTLTITTKEPFPEFPSELVHPNTSIIDVSAANISQQPVGTGPFQVSSFEAGHKIELERYDDYWDGKPKLKHVTFSFNEDANARVMALQSKDADIIYRPSVEDIDQIQKDSSITVDSVPSLRVHQILYNTKKDHLADRHLRRAFDALLNRKEIAESILNGHAQPADGPFLADFPFSSDTVQKPSGLQAAKAELKKAGYELENGKAVKDGKALSFTLLTYQSRPELPLIAQILESNAKELGISIKIQQVENIDEYLAKNDDWDLATYSSMTAPRGDASYLLNTAYMPNGALNYSGIENQTLIKWIKEFNRTIDKEKRNRLAKKAAELIEKETLNSFIVTPENITAYRDGVLNWETSKSEYYMLTKDLDVKTK

SEQ ID NO: 6618 - protein, 313 aa, Bacillus licheniformis
MKQIAKRLFELVLFLFLLSFISFVFMKAAPGDPVKQMLRVDDVAVTDEQIEAFREELGLDKPVYIQYWNWFKRFFQFDLGKSYTTHEPVIDELSRKFPATLLLTGASLLVMLLIAVPVGTLSALYRDRWIDHLSRLLALVGAALPSFWLGLILIDLFSVRLNWLPSMGAGTFKHLILPSLTLGIAMSGVYVRLVRSSLIESLGQDFIRSARARGISEARIFFFHAFRHCLVPVITIFGVSLGSLLGGTVIIEVLFAYPGVGKLVVDAIVQRDYPIIQGYILFMGIAVVLINLLVDLSYRYLNPEIRLKEAGRR

SEQ ID NO: 6619 - protein, 273 aa, Bacillus licheniformis
MRKNVFRSKTGLWFVLLFSAALFTVPFFLPFDPLRTDMANRLQPISMQHWLGTDHLGRDIFSRMVAGAKATVGTALGAILISVFIGVPVGLVSGFFGRRLDRMMMRIVDAVMAFPDYIVAIVLSGLLGPGLMNLILAVVAVKWVGYARLVRSTVFSEKQKDYIALAELTGLSSGAILKKHLLPHVLGNLSVLATLDIGKTVLMIAALSYIGLGAQPPYPEWGAMLNDGKHYFLHAPQLMVIPGLAIMFIVLLSNLYGDRLRDRFDVKHKKGVS

SEQ ID NO: 6620 - protein, 280 aa, Bacillus licheniformis
MPMLSIEDLSISSRQHTIVKNASFSIHEGEWFALLGESGSGKSLTASAIAGLLPDGLTVTGGDVIFEGQQMLQAGRKALRRVRGKDIACIFQDCHGAFTPFIRIGKQIDEMVKTHTGWSKNKRREAILHAFREVSLPENRVYESYPFQLSGGQLQRAAIAQAMVLRPKLLIADEPTTALDSITAADVLQQLAAMRAKTNCAILFITHDLRLVKRYADQTAVMQNGEIVESGLTADLIRQPAHEYTRCLFAAIPPLKNPPPRLTAAPPETKEAVLAGTGGA

SEQ ID NO: 6621 - protein, 261 aa, Bacillus licheniformis
MTHSAETVLFVSNLTKHYACGHKAVDNVSFSIRKGECLGLAGESGSGKSTLARCLLLLEKIDHGEIRLHQHPLTGINKKETRRLRRKLQAVFQNPAASFNPKLNIIDSVMEPLDVSKQDMPSFLRDFRGSRRLTAERLFSMVGLPSRLLDRYPHELSGGQRQRALIARAISTHPSLIIFDEPTASLDVTSQAKILDLLKDLQDAMGLSYLFISHDLAAVHFMSHRIMVMKDGQIADQFEKEELFSAERHPYAKKLLQVFES

SEQ ID NO: 6622 - protein, 452 aa, Bacillus licheniformis
MNHKQYLALAVPLIISTITTPLLGAVDTAVAGQLSSPAYIGGVAVGTMIFNTMYWLLGFLRVSTSGFAAQSLGSQNRSESVLALARPVFIALFAGLMFIILQKPLEYAALTLIQPDRHTAEFASQYFSLRIWGAPFALISYCILGWLMGMSLIKVTLLLQISMNVLNIVLDIVFVYVFHMEVYGIALATLISDVTGCLIGCWLVKTNAAMPFKLPSVKLLFDPKPFKKMMVVNRDLLIRTLCLLTVFNLFTAKGAGFGAEILAANAILIQIHYLMAYVFDGFANASSIFAGKAVGRMDRDLYSRTLSLSIQWSLISAALLSVGYFLLRNAILPLFTPLESVLEAAKTYDVWIALFPLAASFGLVFYGIFTGATEIGPVRNSMFLAVLVFLAAFFTAVPAFGNHGLWLAFLLFSLGRSVFLCMAVPGLTTRLFGERSAAREAGQRPKSLKHPG

SEQ ID NO: 6623 - protein, 213 aa, Bacillus licheniformis
MKTPFIRNDQYNFIKFQTDSLVQGHANINDENVLDALKCNALDQVFNLFPDLSSDQKSLLEKLAEVEDSGEAVRFLAELKLHVIPFQNVTVKTAKKLFSKVKKLKTPEFEQMDFSGYSYLGWNDAGSGRKYMIVDVGGKLTGIHGTIKSSNKKGICSICNRTEEIGLFMARVKSGKETYTDRGNYICCDSEKCNQNLMTLDHLNHFVAQLTKE

SEQ ID NO: 6624 - protein, 112 aa, Bacillus licheniformis
MLRDRGSIKWVSMMLPEHVELLREYHESFQKIKKPILDEQKYEEFNEIICEAMAENRFLQFAYYRQGEVKTLAGRIHYADALKRELRIVSRADEICILKIEDIIEIEYDCRL

SEQ ID NO: 6625 - protein, 420 aa, Bacillus licheniformis
MDYSQYPSRSVLCVDMRSFYASCAGTLLGLDPMTCFLAVVGNTERQGSIVLAASPALKREFGVQTGTRLYQLPDDPRIKLVNPKMGLFVRVSTELTRLFCRYVPPDAIHTYSVDESFIQVDGVESMWGDARTIAMKIQDDMEREFGLPCAVGIGPNLLMAKLCLDLEAKKSAGGVAVWGYEDVKTKLWPLSPLRRMWGIGSRLEKTLNRMGIFTVGQLAHYDLSRLEKTFGVMGNQLYYHAWGIDLSAIGAPLMEGQVSYGKSQILLRDYPNPEEVKHVILEMCEEVAKRARAHRQAGRTVSLGIEYSRDELGGGFYRSKTMESPSNVTLDLYHTCLALFERFYAGKTVRKISVSLSNIQDDTNMQLDLFRPDQEKKRQLGYVMDGIRERYGSTALLRAVSYTNAGTARLRSKLVGGHQA

SEQ ID NO: 6626 - protein, 70 aa, Bacillus licheniformis
MDEKLIEKMLGQALKQYGRNVATDPLSPGEKEILKLALQERRIEEPNEGLHAHIEDVIYDYVTNQGLFSS

SEQ ID NO: 6627 - protein, 412 aa, Bacillus licheniformis
MKQKWQNIHPLSWTIIVGTIFGRMGTAMSIPFLAIYLTQVKGASSGFAGAVIAASSLIGIAASFYGGYLSDRFGRKTIMLVSIFGWTFVFAGFALADHVWTFFIMNALNGLCRALFEPTSRALLSDVSKPETRLFVFNLRYTAINLGVVFGPLLGLYLGSSKTTLPFFIAAFIYFIYAAVLVIQFKHHTVPAAERNKRIKVRDALEVTKTDRVFTITLIGSILCLFGYSHFTSTLAQYMAASPFIEDGTKVFGMMLTLNALAVLAVQYPIVHIAKRFSPILSLIAGNVLISGSLFSLSFFHDLWSIVLIIIVFTIGEVLLFSMMDLLVDRIARPELKGTYFGAMGFTQLGSVVGPWAGGMLLDTFGAEKPFFTFAILSAATICGVPFLVAAYRKLKMDEAKVNLSSKKTMQH

SEQ ID NO: 6628 - protein, 127 aa, Bacillus licheniformis
MIHHIELYVSDLEASKRFWGWFLGELGYEVFQQWEGGISWKANGAYLVLVQAKEQFIKAGYHRCRVGLNHLAFYAASKEQVDEMTMKLRERGCRILYEDRHPFAGGNGHYALYTEDPDRIKVELAAP

SEQ ID NO: 6629 - protein, 319 aa, Bacillus licheniformis
MANQDLNLHTLYTSHTRDAWANLGGHMSVKMTEEEVKKLEGLNDYLSLEEVETVYVPLARLLYLHRATQYERNTRVNGFLNHPHAAKIPFIIGIAGSVAVGKSTTARIIQTVLSRLQERLKVSLITTDGFLYPNAVLTEKQMMSRKGFPESYDVKALLEFLNDLKSGKEIVHAPVYSHLTYDRLEGVYETVEQADIVIIEGVNVLQTPTIEDDRTKPRVFVSDFFDFSIYVDAEEDLIIKWYLERFRMLRETAFQDPSSYFHKFKDLADEEADHMAKSIWETVNRPNLYENILPTKFRSDLILRKGEGHKVEEILVRRV

SEQ ID NO: 6630 - protein, 321 aa, Bacillus licheniformis
MSIKNIYNIFKKELAFQSYSKLLIILLLPLLFISSGYIYVHYKNTMDSYQQFKKTENEYKELGIDIKQALESPVKVKEGELKSEDGDGEIVENILRFDYENFVLSLHHLEPKQSVTMTLELMGFIIFPLAFTLYAIYISSYDIRFKTMKVKAVSHDWKSVLFAKQCSVYMVMAAAVIAVVCTAYVSSLVFYSLASRDIPVGEFTIPAVSKSNILLQLAVVLAVSFIFSTIGFYLGVLFRSFITPALLYVVYSLLIPALGRFDLKNLLSNLGHAVFSFSGGFKLFTPVKVDMIPVIIILAASVGLLSAVTYYMAHRQSKYVV

SEQ ID NO: 6631 - protein, 220 aa, Bacillus licheniformis
MIKIDDLTKSYGSKSVFNRLNMNIEKNKVTFLMGENGAGKTTLLKCLLKLEPFEGGILYDGEPLEAVRSKVHVIYDDSPFYDHLSGYQNIKLLINKPAGKEELEQLSQKFLGRELLKKKVKTYSYGQKKKLALMIAALNKPSFLFLDEISNGLDYRSMMELQELINDWSSRMTIVAAGHQFEFYSSIVDQLYVLKDGSAIHIDNFKTNGAELGDVYKEYL

SEQ ID NO: 6632 - protein, 67 aa, Bacillus licheniformis
MKKAILGFSLSAALLVPSSFAAAAGDGQLTSEQKELLEAKTEYVQSLPEQASVQSGVTAYAGKRADN

SEQ ID NO: 6633 - protein, 86 aa, Bacillus licheniformis
MFQNKIKKAVGAVAFAGALLVSGLPVSADTLPELIWVRDKYPGAQYEYKVINGERYVDVYRVINGKTDVTREKCETMYQDRCYVKK

SEQ ID NO: 6634 - protein, 168 aa, Bacillus licheniformis
MIYIYNCYGGTHSSALAAAYHLKKLPFSRKPTRNEILSTDCFNQLSPKEMGKLIFHGLDEEGNQVYTIGRGSSKAVIPAMRGVLELFEKNGKLQEKVIFSNTSPTVPIAMTFGGLFSRRLKIDPIGVPLLVLGAQQAYQDIIKLVQQTKNHAKTTSSMIEVLDNGFKG

SEQ ID NO: 6635 - protein, 240 aa, Bacillus licheniformis
MQEEWNPLMKNRCIIWLVTGICLTVIFQFPLKSVASSADKYANFAELAEHETEGEDYQIEYTDMGTELLILSPHGGGIEGGVSELVRAFSADYSTYLFEGIKPSQNWDLHITSNHFDEPQALKAVKEHSYVLAFHGYHDIVEHTLVGGTDTGGAKAIVRALLNKGFSAELVSPSHRLAGGNPENINNQCKTGQSIQLEISTPQREAFFSEFGLWTRASSKNETFQAYVSAVKEVLETRYK

SEQ ID NO: 6636 - protein, 260 aa, Bacillus licheniformis
MEQKLKAHKVMITGASGGLGERIAYHAAGEGAEIILAARRRDRLDALKQNIADKTGAKCRIIVLDVSRTDEVEAAFQEAGPVDILVNNAGFGIFESALDASLEDMKAMFEVNVFGLIACTKMALPHMIRQDKGHIINIASQAGKIATPKSSLYAATKHAVLGYSNSLRMELAETGVNVTTVNPGPIQTDFFKTADKKGDYVKSVGRWMLDPDRVAKKIVSAMMTNKREINLPGWMNSVSKLYQLFPSLVERTGRSAFYKK

SEQ ID NO: 6637 - protein, 272 aa, Bacillus licheniformis
MKSELAEQGLSLSDIDQVVLTHHHADHAGLLNEFPAEVKIIGHPFNEPYISQNPDFIEKQKSFFTYLFQRFGVPGDMKPPGHTIKASYRYSCNRTLTETVSEGGQIEGLDGWRVLETPGHAASHIVLYNEELGSMLGGDLLLKPSSSNPLLEVPQKGGKRPTPLLDYLESLGRLQELPLHMIYPGHGEEITKVNELVAKRLEKQRNRAEEVYRILSEKPHSPYQICRKLFPAVYEKELFLTLSETIGQLDDLESQGRIGVDAADGIDYYYAK

SEQ ID NO: 6638 - protein, 273 aa, Bacillus licheniformis
MKRIGFIGAGSMAEAMIKGLVKSGAMEPEAIFVTNQSNTARLRELSETYGVCGEADTAKVAARSDTLVLAMKPKDAAGGIAALRPYLRKEQLLISVLAGIPIHTIQHYAGLELPVVRAMPNTSAAIQKSATAFAASPLVTKEQMQEAADLFATVGSVTIVEESALDAVTAVAGSGPAFVYRFVEALQASAAELGLPEKTAKQLIIDMMAGAAQMLETGRDPSVMRKEITSAGGTTEAGLRMLDDHQFEQTVISCVKEAANRSAELRDMFAAKI

SEQ ID NO: 6639 - protein, 534 aa, Bacillus licheniformis
MKWQTVEELKRLLISLVQYESISGTAGEVALAKYMHDVLKDRSYFQKNPEYLKLHPMEDGRYFLTALVKKEKKSNTVLLLSHFDVVDTADYGEFKHMACKVPELMDLLNDKKELLPERVKKDLESGEWLFGRGSMDMKAGLAVQFSMLERAMNGEFDGNLLLITVPDEEVNSQGMLEAVPVLKALEKEFGLHYTACLNCEPMFEKHPGDPKQYVYSGSIGKALAGFFCKGVETHVGEPFAGVNANLMVSEINRLLELNVDYCEEADGEVTPPPANLMQKDLKEAYSVQTPHTAVSLFNVLMMQRSAAELHRMLLDTAREAAANIQTNIERKTAEYQRFEAFTPINPAVSVMTFEELWNKAQEKAGKPEAERILNFAFANRGELGDRDFSTKIVSELASLCKEDAPMIVLFYSPPFYPAVSSKDDPLIRKVMREVKQYAADRHGIEFTEVQYFPGLSDLSYLQLQKQSVDAFTSNMPLFHHGYSLPKGRENALFVPVINIGPAGKDPHKWTERLHVPFSFGKLPDILRLAIHKLL

SEQ ID NO: 6640 - protein, 339 aa, Bacillus licheniformis
MSNRKLFTPWSLKGVTLKNRIVMSPMCMYSSHEKDGKVQPFHMTHYISRAVGQVGLIMVEATAVTPQGRISDQDLGIWDDAHIDGLAALTSQIKTYGSKTAIQLAHAGRKAEVEGTIYGPSAIPFDENSRTPVEMTKEDIKETVQAFKKGAERAKAAGFDIIEIHGAHGYLINEFLSPLSNKREDEYGGSPENRYRLLREVIDAVKEVWAGPLFVRVSASDYKTKGLDVADYVGFAKWMKEQGVDLIDVSSGAVVPADINVFPGYQVGFADTIRAQAEIQTGAVGLITSGLQAEEILQNGRADLIFVARELLRDPYWPKTAAKQLNTKIEGPVQYDRAW

SEQ ID NO: 6641 - protein, 253 aa, Bacillus licheniformis
MTITERIYTVEGCMFYTKQRKGKKNATIIFEAGYGFSSTTWQPILSDIDEDLGLFAYDRAGLGKSGPSTSKRTADQMVKELKALLAAADVKPPYLFVAHSFGAVIARLFASRYSDEVIGMVLLDPACEDQEEKVLPLLPDTLKEDYVKQFSIEGSHEDFKQSLDMLKQEKKHLGSVPLLVLSAGKRTEAAKQAHQEWLKLHSRLLSLSHQSGWIQAKNSSHLIHHDEPHIVQLAIYDVWYAAQQQTYAYQAAN

SEQ ID NO: 6642 - protein, 49 aa, Bacillus licheniformis
MRVKITLACTETGDRNYITTKNKRTNPDRLELKKYSPRLKRHTIHRETK

SEQ ID NO: 6643 - protein, 307 aa, Bacillus licheniformis
MELLFLGTGAGIPAKTRNVTSVALKLLEERRSVWLFDCGEATQHQILHTSIKPRKIEKIFITHLHGDHVYGLPGLVSSRSFQGGEGPLTVYGPQGIKTFLETALDVSGTHVTYPLVIKEIGEGTVFEDDQFIVTARSVSHGIPAFGYRVQEKDVPGALDAEALKEIGVSPGPVYQKLKNGETVTLEDGRTIHGADFIGPPKKGRIVAFSGDTRPCENVKRLAEKADVLIHEATFAKGDRELAGDYYHSTSEQAAETAREACAKKLILTHISARYQGENVLELVDEAKAIFPDTVAAFDFYEHEIKRT

SEQ ID NO: 6644 - protein, 492 aa, Bacillus licheniformis
MKKDQMEPKAVIVIFGATGDLAKRKLYPSIHRLYENGQIGNEFAVVGVGRRPWTNEDFRSTVQQSVSKFPLNEKDVDEFTSHFYYHPFDVTNSGSYRELNELIEKLESTYDIPNNRMFYLAMAPEFFGTIAKFLKSEGVTSTTGWSRLVIEKPFGHDLPSAKALNQEIREAFTEDQIYRIDHYLGKQMVQNIEVIRFANAIFEPLWTNRYISNIQITSSEDLGVEDRARYYEKSGALRDMVQNHILQMVALLAMEPPIKLNTEEIRSEKVKVLRALRPIQKDDVDQFFVRGQYDAGVVDEKHVPAYRDEQNVAKDSNTETFVAGKLLIDNFRWAGVPFYIRTGKRMQKKSTQIVVQFKDIPMNLYYGNGNTMHPNLLVIHIQPDEGITLHLNARKLGGGTFAQPIKLDYCHNCGDGINTPEAYEKLILDCLHGDATNFAHWDEVALSWSFVDAISQNWEENKTLSPNYKAGSMGPKASDDLLAKDGFHWWPL

SEQ ID NO: 6645 - protein, 654 aa, Bacillus licheniformis
MTEQLSEKDQQELLEKYDPEAGTRKLKGLTGAIAFAGLLAFSLFQLYTAIFGVFPAQIQRSVHLGFALGLIFLLFPATKGLRKTGKFKVAWYDAILAVLGAGVGAYWVANYETIVGGIGLITETDFYVGLLAVLLVLEATRRAVGLPITIIAGLFLLYGLYGSYLPGFLSHNGLTMERLVQTMYFTTEGILGTPLAVSSTFIFLFILFGSFLVRTGVGQYFNDLAVAIAGRSTGGPAKVAIFSSALQGTISGSSVANVVTSGSFTIPMMKKLGYKKEFAGAVEASASTGGQLMPPIMGAAAFLMVEFIGGGITYWDIAKAAAIPAVLYFTGIWIMTHFEAKRLGLRGLTKEEMPNRKEVFKKIYLLLPIISVVVLLMSGITVMHAALYSIVLAILVGLFNKETRMGVKGIVLALAEGARMALSVAAATAAAGIIVGVVTKTGLGLKLANGLLDLAGGALLPSLFLTMIAALVLGMGSPTTANYVITSTIAAPALILLNVPDLSAHLFVFYFGIVADITPPVALAAFAAAGVAGGEPIRTGINSAKLAIAAFIIPYIFVLSPELLMIDAHWYEILWVVFTALSGMIAIGAGMIGFWMRKVFWFERILAAASGLLLIYPEGYSDMIGLGIFLLLFVLQLMWKRDKSHPEEMQALKA

SEQ ID NO: 6646 - protein, 172 aa, Bacillus licheniformis
MGKLKIIKRLVPALIIAVFAAACLIPYQTAVVFEKEDSGEIIAFLPLQKKKSFDVVYTHSIHRTEVIESYVWEKGMIRQTALTYHDPAVGMPANAEQGERLDIKNGVYTISNMKRTFPFIDMRIGRVRANHRIKYSGAEHELKRYIRPGTWTRMSVRKLNVLQQLRGVKIND

SEQ ID NO: 6647 - protein, 329 aa, Bacillus licheniformis
MKKWKSLSWMVLLLTLVMGLAACGSNNASGNKDGGSASKGSGNYSLLTGGTGGTYYPLGGQFANLWEDATGDKFTTQTTGASAENMATLQKGEAEVAFSQTDIATYAIEGKEMFKEKIEGIKAIAALYPETVQIVTTEKSGINSVEDLKGKTVSVGAAGAGVNINAKQILEVHGMSFDDIKPQNLSFEESTDGIQSGAIDAAFITAGTPTGAVEGLSAQNKIKIINIEKDKQKKLIEKYPFYAEDTIKKGTYGIGSDVNTVAVKAMLVASDKMDEDTVYKMTKALFEADKINHAKGEFIKPETALEGLGDIDIHPGAAKYFKEKGIEKS

SEQ ID NO: 6648 - protein, 237 aa, Bacillus licheniformis
MRKYEYISNEMRRRIQEEYYPIDQPIPDELSLAKEFSCSRMTMKRALDILVSEGMLYRKRGHGTFIVKSSIQQLPVSVTDRENLGLTKLLANKQIESRIIQFDVEFPSDEVAKQLSIEKTVPVYHIIRLRKVEGEPYVIEETYMPSNVISELNEDVLHGSVYRHITETLKLTIAGSHRKIRADKSSALDREYLECAPDDPVLEVEQVAFLNTGEPFEYSFARHRYDKFVFSSVHIRK

SEQ ID NO: 6649 - protein, 471 aa, Bacillus licheniformis
MSKTEPQLEQIQYRFPNGFWWGSAASATQTEGAAAEGGKGKNIWDHWYEKEPNRFFDGVGPEKTSRFYETYREDIQLMKELGHHSFRFSISWARLFPDGKGRLNKEGAAFYNRVIDELLAAGIEPFVNLYHFDMPLALQQIGGWENRQVVDHFASYAETCFRLYGDRVKKWFTHNEPIVPAEGGYLYDFHYPNIVDFQKAVQVAYHEILSNAKAVEAYRRLGGDGKIGIILNLTPSYPRSQHPADVRASEIADAFFNRSFLDPAVKGEFPQLLTDILKEEGYLPVMEEGDLELIKNHTVDLLGINYYQPRRVKAKEHLPHPDAPFMPERFFDHYEMPGRKMNRHRGWEIYEKGIYDILINVKENYGNIECFISENGMGVEGEERFRGEDGMIRDDYRISFIKEHLKWVHRAIQEGANVKGYHLWTFMDNWSWTNAYKNRYGFVSVNLDKNGERTIKKSGYWFKKVAENNGF

SEQ ID NO: 6650 - protein, 128 aa, Bacillus licheniformis
MKQVAKLGAAPGIFNVNEPIIFGLPIVMNPLIFIPWVISPMIVTLITYFAMASGLVPPPTGVTIPWTVPIFISGMMATNSLAGGILQIVNLAVVFMIWFPFLKFIDRMNMKKEQEINEAEQEKTTLGL

SEQ ID NO: 6651 - protein, 297 aa, Bacillus licheniformis
MFEKLSNLLVPIAGKLNNNRYLGVLRDAFMLAFPLTIFGSIIVVLTNLPFLNKMMSKSALETFQSALSIAPSATISIMSVFVVFGIGYYLSKTYEVEAVFGGVVALASFLLLTPFVLNGEGGEVIPNVIPIDRLGAKGMFLGMITAFTSAEIFRFFVQKNYTIKMPAGVPPAVAKSFAALIPAVMTLSVYLVINILVTQAFNTNMHDLIYNLVQAPLVGLGSGIIPTLIAIFFTQLLWFFGLHGQIIINSVMDPIWNTLSIENLNSYTATGEVPHIINKQFMEVYTVGMGGTGMTLA

SEQ ID NO: 6652 - protein, 113 aa, Bacillus licheniformis
MTIMEKLKLDELTGEQICFQLILHSGNARSKVIQSIREYRAGSVQKAEELLQQAEDDLQQSHDIHFQMIQKEAGGGKNEFSLLLLHAEDHLMSTLTMKELVSELLELFKEKSL

SEQ ID NO: 6653 - protein, 102 aa, Bacillus licheniformis
MKKILLACSSGMSTSLLVTKMQEYAHSIGDEAKIWAVGQDQAKKEMAEANVVLIGPQMSFLKGELQKEAEQYGIKVDVIDMLAYGMADGKKAYEQALSLIGD

SEQ ID NO: 6654 - protein, 553 aa, Bacillus licheniformis
MGFLRNRIVGITLAGAVALGSAGTGSAAMETAKKKEEPKVKNVIMMVMDGTSSSATTLARWYKGEPLAMDQIVSGGVRTYSAESAITDSAPAATAMATGRKSNSSYIGVLPSKVNTPGVEKVREKDHYRPVANVLEGAKQKGKATGIIATSEIQHATPAGYSGHHKDRNNFEVLGEQQVYQNMDVVLGGGKESLQPGTKDKSRKDGEDLVKVLKDKKYDFVETKDQLLKSKSKKIWGAFSQRDLAYDMDRRATHPEQPTIAEMTKKSIQTLSKDKDGFFLFVEGSKPDWAAHQNDPIGMISDVLAFDNAVKEALDFAKKDKHTMVIAVSDHGNSGISIGNSNTTKGYDTTPVSAYVDPLKKAKMTVEGATGKLKDDLSNIEEAAKLYGLDDLTPAEKEQLKSVKNKKEAASLFTKLLSNRANIGFTTGGHTGEDVFLYSYGPEKPQGLVENTDIAKTMAKAMGFNLDKLTNELFIEAKQAFKKAGASVTIDQKDPANPVLVAARKKAKAEMPVNKNIIRINGKEYELDSVIVESNGSFYVPKEAVQLFKKYAR

SEQ ID NO: 6655 - protein, 261 aa, Bacillus licheniformis
MYPSLEGKTVVITGAGTGLGKAMALRFGAEKANVVINYFKEEENPEETVEKIESSGARAIAVQGDVSKEDDVKALIRQAVDSFGSVDVMVNNAGVENEVPSEDLALEDWNRVISTNLTGMFLGCREAIGYMLDHNIKGSVINMSSVHQQIPWPHFVHYAASKGGAKLLTETLALEYAPKGIRVNAIGPGAIDTPINAEKFADPELKKGVIELIPIGYIGKPEEVAACAAWLASEEASYVTGLTLYVDGGMTKYPGFQAGKG

SEQ ID NO: 6656 - protein, 469 aa, Bacillus licheniformis
MAKQQIGVVGLAVMGKNLALNIESRGFSVSVYNRSSEKTEEFLKEAEGKNVVGTYSIEEFVESLEKPRKILLMVKAGTPTDATIQSLLPHLEKGDILIDGGNTYYKDTQRRNRELAESGIHFIGTGVSGGEEGALKGPSIMPGGQKEAHELVKPILEAISAKVDGEPCTTYIGPDGAGHYVKMVHNGIEYGDMQLISESYFILKHIVGLSSDELHEVFSEWNKGELDSYLIEITADIFTKKDEETGKPLVDVILDKAGQKGTGKWTSQSALDLGVPLPIITESVFARFISSMKEERVKASKLLAGPEAKPAAENKEELIEAVRKALFMSKICSYAQGFAQMKAASEEYGWDLKYGDIAMIFRGGCIIRAAFLQKIKEAYDRDPELDNLLLDPYFKNIVESYQGALRKTISLAVEQGIPVPCFSSALAYFDSYRTATLPANLIQAQRDYFGAHTYERTDKEGIFHTEWMK

SEQ ID NO: 6657 - protein, 418 aa, Bacillus licheniformis
MSADKQKGRVIFHIDMNSFYASVEMAYDPSLKGRPLAIAGNAKERKGIVVTCSYEARARGVKPPMPLWEAKRLCPELIVKPPNFDRYRSSSREMFQVLREYTDLVEPVSIDEGYMDLTDTPYRNRACETAKEIQERLQKELLLPSSIGIAPNKFLAKMASDMKKPLGITILRKREVPRILWPMDISEMYGVGRKTAEKLKTLEIEKIGDLAAADEYALKRLLGINGPRLKRRANGIDTGEVNPDRIYEFKSVGNSSTLPHDSTDEKELFGLIDKLSISVSDRLKRKEVMAAKVFIMIRFADWTNITRSKTLLNPTDSKDEIAKESKALFRQHWHGSPVRLLGVTGTDLVNRKEAVKQLDLFSFHEDAKDEPIQKVMAELNEKYGTDLIKKGVRIVKKESKTSGTSFNKDFFQDERQDQ

SEQ ID NO: 6658 - protein, 95 aa, Bacillus licheniformis
MILESFNDAFFLIEFFTIVLPALTAIGIALILKDCSTGDSWKTKRFEEYHAIQFVSAVDFLIILYHRITVWISKVIRMKASSNDDEDHRFLLLSI

SEQ ID NO: 6659 - protein, 273 aa, Bacillus licheniformis
MNTKLKQLFATAMFLIMTMFIGEQASAATGSTGGSDNFFHHYVVVPFSELIKGIAGIFHGNYGLSIIFVTIIVRVLVFPLFANQYKKQRAMQEKMALVKPELDAIQSRLKKTKDPVKQREIQQEMMQLYQKHNINPLAMGCLPMLIQFPILIGFYYAIRSTPEIASHSFLWFNLGHSDIIVSLSAGFMYFIQFYVSQKLNAQNAQSNPAAQQSAKIMGFFFPVMMTIFSINVPAALPLYWLTSGLLLTIQSVVLHQVYQKNKKAIQPAESATK

SEQ ID NO: 6660 - protein, 372 aa, Bacillus licheniformis
MNKKRLLEEFLELVQIDSETKHEAEICKVLKEKFAALGMDVVEDDTKPKTGHGAGNLVCTLPGTKEADTIYFTSHMDTVVPGKGVKPVIEDGYVKTDGTTILGADDKTGLAAMLEAVKVLKEKNIPHGTIQFIITVGEESGLVGAKALDRSLIKADYGYALDSDGKVGNIIVAAPTQAKIRATVYGKTAHAGVEPEKGVSAITIASKAIAKMPLGRIDEETTANIGRFEGGTQTNIVCDQVDILAEARSLVPEKMEKQTEKMKQAFESAAAEMGGRAEVEIEVMYPGFKYKDGDLVVEIAKKAAGKIGRPYELLTSGGGSDANVIAGHGIPTVNLAVGYEQIHTKNEKMPIEELVKTAEMVVAIIEEVANRS

SEQ ID NO: 6661 - protein, 509 aa, Bacillus licheniformis
MNMFERVDDLNNSRQKASLGGGQERIDRQKQKGKLTARERIDLLLDEGTFTELNAFARSRQSGGPLGDGVVTGFGKIDGRPVYLFSQDFTVTGGALGEMHAKKIAAVMDLALKNKAPFIGLNDSGGARIQEGVLSLDGYGHIFYRNVLCSGIIPQISVILGPCAGGAVYSPALTDFVFMSEKTGQMFITGPKVIKTATGEAVSSGELGGAYIHNSISGNAHFSGDSDEAVLHEVRKLLSYILQNHEEKPPAKARKAKDHEIRPALMTILPEDGQRPYDVKQIIAEIADGGTFFEVQCHFAKNAVIGFARIAGETAAVVANQPKYLAGSLSMDAADKIARFIRFCDSFQIPILTLVDCPGFLPGIREEHGGVIRHGAKILYAYAEATVSKVTVILRKAYGGAYVALNSKALGADAVFAWPNAEIAVMGASEAADVLFAKEIERSDDPRAAREEKIRKCMQASSPFTAARYGMVDDIIDPKETRKKLIQTFDMLKSKKEIRLDKKHGNIPL

SEQ ID NO: 6662 - protein, 319 aa, Bacillus licheniformis
MFKIGYRTLKTALGTASAIYIAQLLGLHNFVSTGIITILCIQVTKKRSLQASWARFAACILAIVFSYAFFELIGYHPAVIGLMLLFFIPTTVLLKIKEGIVTSSVIILHLYMSEGITLSLVWNEFLIIITGIGVALLMNLYMPSLDKELKQYQQKIEDNFAKIFEEIERYLLTGEQDWTGKEIPETHRLINEAKTLAYRDVENHFLRHENLYYHYFKMREKQFEIIERVLPKITSISMTVEQGQMIAAFLHDLRGAIHPGNTAHKFLKRLVKMREEIEEMELPTTREEFEARAALFIFLGEMEQYLVIKSYFKGIKSPA

SEQ ID NO: 6663 - protein, 240 aa, Bacillus licheniformis
MINVRNLSKSFGKHEVLKHISVSFEKGEVAAVIGPSGSGKSTFLRCLNLLEKPTEGSIFIQDQEITSPKTNVLKIRENIGMVFQHFHLFPHKTVLENITYAPVHVKKESKQAAVKKAEELLEKVGLLDKKDDYPNRLSGGQKQRVAIARALAMNPDIMLFDEPTSALDPEMVKEVLQVMQDLAKTGMTMVIVTHEMGFAKEVADRVLFMDEGTIVEDDDPKAFFSSPKSKRAQDFLEKIL

SEQ ID NO: 6664 - protein, 220 aa, Bacillus licheniformis
MNFLDFSSTVPEMPFILEGLGVTLKVVAAAAVLGFLLGVLITLLKISSIKPLAWIADFYTSIFRGTPLVLQLMIVYYGLPQVLGFDIDAYWAAVIAFGLNSAAYVSEIIRAGINAIDKGQKEAAMALGVPYAKMMKDLLLPQAFKNIMPALINESITLTKESAVVTVIGLGDIMRRSYQAGAAIYSPLEPMLFAGLIYYVLVLILTFVGKAIERKLNVND

SEQ ID NO: 6665 - protein, 179 aa, Bacillus licheniformis
MKKWMLLVVTACVTFALTACGTSSSSDDKKTLVMGTSADYPPFESKDGDKIVGFDVDLAEALAEKTGHEIEVKDMDFNGLVTALKTNKVDIVLSGMTPTPKRKKQVDFSNVYYTAHNMIVTKKSSGIKSLDDLKGKTVGVQLGSIQEEKAKELTPDYDLKVENRNRISDLTEEIKAGHL

SEQ ID NO: 6666 - protein, 145 aa, Bacillus licheniformis
MNMDFNLFMNDVVRQARQEITAAGYTELKTPEEVDEALTKKGTTLVMVNSVCGCAGGIARPAAHHAVHYDKRPDHLVTVFAGQDKEATARAREYFEGYPPSSPSFALLKDGKILKMVERHEIEGYEPMAVITKLQGLFEEYCEEV

SEQ ID NO: 6667 - protein, 300 aa, Bacillus licheniformis
MNRKKAMLIYNGNAGQKNVEKTLGAAVPILSQAIDELIVKPTRKKRDAFEFCLEIGEDIGQLFILGGDGTVHECINGISQLQTKPDIGILPGGTCNDFSRALRIPQNIEKAAEALANGSPVPVDVLKANDHYCLNFWGIGLITEASSHINQTEKALLGRISYFTSALRTISNLEPFSFRLSIDGEEFADEAVMVVVLNGPFIGTNKIPLPQLSINDGKADILVCRNTNLAALKELFAMDDPEWDSFKGELSYYQGQTVRIETALPMEADTDGEICTKTPASIEVLNGHLRMLTPLEKEKS

SEQ ID NO: 6668 - protein, 426 aa, Bacillus licheniformis
MAVEQMTMPQLGESVTEGTISKWLVSVGDHVNKYDPIAEVMTDKVNAEVPSSFTGTIAELVGKEGETLQVGDVICKVETNEEAKPEAEAVSKPDQEEAEPAKPEAKDTSQKKRYSPAVLRLAGEHNIDLEQVEGTGAGGRITRKDIQRIIASGAVPQTDAAPEKQPGANAAGAIEPDQKPAQAAPQAAPPQSAAGDVEIPVTGIRNAIATNMVRSKHEIPHAWTMMEVDVTGLVSYRNKIKNEFKKKEGFSLTFFAFFVKAVAQALKEFPQMNSMWAGDKIIQKKDINISIAVATEDALYVPVIKHADEKTIKGIAREISELAHKVRSGKLTSGDMSGGTFTVNNTGSFGSVQSMGIINHPQAAILQVESIVKRPVVMEHGMIAVRDMVNLCLSLDHRVLDGLICGRFLARVKEILEQIDDHTSIY

SEQ ID NO: 6669 - protein, 327 aa, Bacillus licheniformis
MPVMSYIDAVTLALKEEMEKDPRVFVLGEDVGKKGGVFKATAGLYDQFGEERVMDTPLAESAIAGVGIGAAMYGMRPVAEMQFADFIMPAVNQIISEAAKIRYRSNNDWNCPIVIRAPYGGGVHGALYHSQSVEAVFANQPGLKIVMPSTPYDVKGLLKAAIRDDDPVLFFEHKRAYRLIKGEVPSDDYVLPIGKADVKREGEDITVITYGLCVHFALQAAERLAKDGISAHILDLRTVYPLDQEAIIEAASKTGKVLLMTEDTKEGSIMSEVAAIISEHCLFDLDAPIKRLAGPDVPAMPYAPTMEKFFMVNPDKAEAAMRELAEF

SEQ ID NO: 6670 - protein, 330 aa, Bacillus licheniformis
MGNNRHEAVGLTDEQAIDMYKTMLLARKLDERMWLLNRSGKIPFVISCQGQEAAQVGAAFALDRENDYVLPYYRDMGVVLAFGMTAKDLMLSAFAKAEDPNSGGKQMPSHFGQKKNRIVTGSSPVTTQVPHAVGVALAGRLDKKDIATFVTFGEGSSNQGDFHEGANFAAVHKLPVIFMCENNKYAISVPYEKQVACENISDRAVGYGMPGVTVDGNDPLEVYKAVKEARERAGRGEGPTLIETISYRLTPHSSDDDDRSYREREEVAEAKKNDPLNKFAQYLKEAGLLDDQSEKQISDEITKIVNEATDYAEHAPYADPEDALRHVYAE

SEQ ID NO: 6671 - protein, 473 aa, Bacillus licheniformis
MATEYDLVILGGGTGGYVAAIRASQLGLKTAVVEKQKLGGTCLHKGCIPSKALLRSAEVYRTAKKADEFGVVIPEVGLRFSQVQSRKQKIIDQLHNGVKHLMKKGKIDVYEGIGRILGPSIFSPMPGTVSVEMANGDENEMLIPKNVIIATGSRPRSLPGLELDGENVLSSDEALELEQLPASMLIVGGGVIGIEWASMLNDFGVDVTVIEYADRILPTEDADISREMQAQLAKKGITMITGAKVLPDTLEKGDAVSIQAEKDGEKQSYSAEKMLVSVGRQANIEGIGLENTDIQVENGFIVTNSMYQTKESHIYAIGDVIGGLQLAHVASHEGITAVEHIAGENPHAIDYSLVSKCIYSSPEAASVGLTEGEAKAQGKSVKVGKFPFQAIGKALVYGETDGFVKIVADRETDDILGVHMIGPHVTDMISEAGLAKVLDATPWEVGQTIHPHPTLSEAIGEAALAVDGKAIHF

SEQ ID NO: 6672 - protein, 368 aa, Bacillus licheniformis
MQVQEKRILVINPGSTSTKIGVFHDDRSIFEKSIRHDEAELQQYQTIIDQYSFRKQAILETLHEQGINISKLDAVCARGGLLRPIEGGTYEVNDAMIVDLKNGYAGQHASNLGGIIAREIADGLNIPAFIVDPVVVDEMAPIAKISGTPAIERRSIFHALNQKAVARKAAWQFGKRYEDMKMIITHMGGGITIGVHCRGRVIDVNNGLHGEGPLSPERAGTIPAGDLIDMCFSGEYTKDELMKMLVGGGGLAGYLGTTDAVKVEKMIKEGDQKAALIYEAMAYQIAKEIGAASAVLKGEVDVIILTGGLAYGKSFISSIRQYIDWISDVVVFPGENELQALAEGAFRVLNGEEEAKQYPNQRRESHGN

SEQ ID NO: 6673 - protein, 364 aa, Bacillus licheniformis
MELFRYMEQYDYEQLVFCQDKQSGLKAIIAIHDTTLGPALGGTRMWTYESEEAAIEDALRLARGMTYKNAAAGLNLGGGKTVIIGDPRKDKNEEMFRAFGRYIQGLNGRYITAEDVGTTVEDMDIIHDETDFVTGISPAFGSSGNPSPVTAYGVYKGMKAAAKAAFGTDSLEGKTVAVQGVGNVAYNLCRHLHEEGAKLIVTDINKEAVERAVAEFGARAVDPDDIYSQECDIYAPCALGATINDDTIPQLKAKVIAGAANNQLKETRHGDQIHDMGIVYAPDYVINAGGVINVADELYGYNSERALKKVEGIYGNIERVLEISKRDRIPTYLAADRLAEERIERMRQSRSQFLQNGHHILSRR

SEQ ID NO: 6674 - protein, 303 aa, Bacillus licheniformis
MKLKQLLQKAAELDNKTVAVAHAEDDEVLQAVKLAVDKQFARFLLIGHREKLRHMMTEQNISKRHVDIIHSESPADSARIAVQAVKSGNADVLMKGNVPTAVLLKAVLNKEYGLRSSHVLSHVAAFEVSGFERLIYVTDAAMNISPKLDELKQILENAVGVARSVGVQMPKVACLAAVETVNPAMEATLNAAALTQMNHRGQIKNCVVDGPLALDNAISPLAARHKNISGIVAGEADILLVPSIETGNVLYKSLIHFAGAKVGAILAGAKAPIALTSRADSAENKLYSIALALCTSEARHEEE

SEQ ID NO: 6675 - protein, 688 aa, Bacillus licheniformis
MQKVLIVGAGKGGTALLDLLLKTKTMHIEAVIDKNPEAPGLFVAQKNDIETALDWTPYITEQIDIIIETTGDAGVLKQLMRKKHDRTIVVPGSLAYIISQLMNEKQQLIQMLKEQTYKHDRIFNSMNDGMIFIDINEEIILFNKMAEVMTGTKRSEAIGQHIQSVIPTTKLPRILNTREPEYHQKQFLHPNRQIVTTRIPIIDDGGTLLGALSIFKDITDAVELAEEVTNLKEVRTMLEAIIQSSDEAISVVDENGNGMMINRAYTKMTGLTKDQVIGKPANTDISEGESMHLKVLETRRPVRGVRMKVGPNKKEVIVNVAPIIVDGILKGSVGVIHDVSEIQSLTNELNRARQIIRTLEAKYTFADIIGSSEQMLVALEQAKLGAKTPATILLRGESGTGKELFAHAIHNESDRKYNKFVRVNCAAISESLLESELFGYEEGAFSGARRGGKKGFFEEANNGSIFLDEIGELSLNTQAKLLRVLQEKEIVRVGGTKPIPVNVRVIAATNVNIEKALAEGRFREDLYYRINRYPISIPPLRQRKEDIEALSRHLIGKINQEYGRNVKGLTKNALKSLKARKWPGNVRELENVLERAMIFLKPQMEWIDLEHLPEADRPRKKVEAGEAFPEIEDEKLSDAVERFEAHIIKETLEKHQYNRTKTAKALGISIRNLYYKMDKYNLAKDSMQ

SEQ ID NO: 6676 - protein, 84 aa, Bacillus licheniformis
MGRMIALLVLLIPGGLAALGIKLMRDTVFGILIGPFQILWLQGLAGFICFAGGLYLLGGFILYRDRKRNQVSPRFRKKQSGREV

SEQ ID NO: 6677 - protein, 241 aa, Bacillus licheniformis
MTKIFAHRGASGTFPENTMAAFKHAAAIGADGIELDVQMAKDGRLVVIHDEKLDRTTSLKGYVKDLTYEEIKHGDASHRFAEKTGSVPVPTLEEVFEWAADAEFLLNVELKNSIIRYEGMEEKVMSMIEAYDLQDRIILSSFNHESLALCHRLNPSIELAALYMDVIYKPEEYIEMIPASGFHPYRRSMSDDTIKNAHLKEKAVRPFTINREEEMKKLIAAGIDGFFTDFPEKALKLKAEM

SEQ ID NO: 6678 - protein, 206 aa, Bacillus licheniformis
MKLLIKSFVLLLFSFMAAFPAAFAAEPLSGKTVYVDAGHGGEDSGAVGNGLLEKDVNLEVAMLIDEKLKEEGADTVASRTDDTFLTLEDRVAKASKNASDLFISIHANSAVPEASGTETYFDSTYQAADSERLASDIQERLPDALGTRDRGVKESGFYVIKNSQMPSVLVELGFITNKTDADKLESPEYQEKAADAIADAVVSYYE

SEQ ID NO: 6679 - protein, 106 aa, Bacillus licheniformis
MRKGVILVLFAMLLLAGCGTTQHNGQSGDESRKGTGEETLVKEGTFVGLADQHTVAVNIDGKETMFQVPPEKRDKYKGIEDDTKVEVEYTKAEDGTLQLEDMKKKE

SEQ ID NO: 6680 - protein, 127 aa, Bacillus licheniformis
MIFTKTDLRYPVNFFGPGLRINHYGLLIVNSNAKIGANCDIHQGVNIGQNHARRDVPTIGDNVWIGPGAKLFGDIHIADGISIGANAVVNKSFTEENITIAGMPAKKIKEAPSNKDRKQAVQRQIQA

SEQ ID NO: 6681 - protein, 98 aa, Bacillus licheniformis
MKVNKLLTGTTLAVGLLISAAPVFAASHSSEVIAHPTAQYINCPSDLPSSFKSSKSSKCVKSSSGVFSNKFSDSDGTWYFKGKFYSNVFNTWVGFYEG

SEQ ID NO: 6682 - protein, 266 aa, Bacillus licheniformis
MEKIKVCVADDNRELVGLLSEYIEGQSDMEVLGVAYNGQECLSLFKDKEPDVLVLDIIMPHLDGLAVLERLRESQLKKQPNVIMLTAFGQEDVTKKAVDLGASYFILKPFDMENLVGHIRQVSGNGSQLTHRAPSSQSSVLRPQPESPKKNLDASITTIIHEIGVPAHIKGYLYLREAISMVYNDIELLGSITKVLYPDIAKKFNTTASRVERAIRHAIEVAWSRGNIDSISSLFGYTVSMSKAKPTNSEFIAMVADKLRLEHKAS

SEQ ID NO: 6683 - protein, 446 aa, Bacillus licheniformis
MNVAKEIYMVWVRCEESEKVDVEKIRKAVGIILLVSLISVGFYKPVKEYIVIPKNLNIFETGTRAVETSLSVSTPKDGSSEAFTLKENQNEVEIKGEKNGKAELVYDFAGFPVKKTKVNVLPDLKVVPGGQSIGVKLHSVGVLVVGFHQINTSEGKKSPGEAAGIAVGDIITEINGTKIEKMNDITPFIQKAGKTGETLHLSIKRDKQEIKTKLVPKKDQAEDKYRIGLYIRDSAAGIGTMTFFEPKSKKYGALGHVISDMDTKKPIVVEKGQIVKSTVTSIEKGTGGNPGEKLARFASERKVIGDINRNSPFGIFGTLHESIKNRIADKAIPIAFSDEVKEGPAQILTVIENDKVEKFDIQVVSTTPQKFPATKGMVLKITDPRLLSKTGGIVQGMSGSPIIQNGKIIGAVTHVFVNDPTSGYGVHIEWMLSEAGIDIYKKEKAS

SEQ ID NO: 6684 - protein, 576 aa, Bacillus licheniformis
MLAELSIKNFAIIEELTVSFEKGLTVLTGETGAGKSIIIDAVSLLVGGRGSSEYVRYGEKRAELEGLFLLDGGHPVFDLCTELGIEASDDMIVMRRDINANGKSICRVNGKLVTIAALREVGRLLLDIHGQHDNQLLMEDEHHLQLLDRFAGEEIENALKAYQEVYSRYMDVMKKVKELSESEQEMAHRLDLIQFQLDEIESANLEPKEDELLQEERRQIANFEKIYEALQNAYNALRNEQAGLDWVGMASSELENVSGINEGLNKVSESVANAYYILEDSTFQIRNMLDELEYDPERLDYIESRLNEIKQLKRKYGATVEDIQAYSAKIEEEIDRIENRDSHLQALKSRLESIGKDVAIEAANVSEIRKKWAEKLAKQIQQELKDLYMEKSTFDTEFHVKKAERDDDAPVVNGMPVQLTKHGIDTVRFLISTNTGEPLKSLSKVASGGELSRIMLAMKSIFSAQQDVTSIIFDEVDTGVSGRVAQAIAEKIHRVSIGSQVLCITHLPQVAAMADTHLLITKQSKDGRTTTSVTPLSKQEKIAEIGRMIAGVEVTDLTKRHAKELLNQAKLVKTSG

SEQ ID NO: 6685 - protein, 149 aa, Bacillus licheniformis
MNKGQRHIKIREIITANEIETQDELVDILKKDGYNVTQATVSRDIKELHLVKVPTNNGSYKYSLPADQRFNPLSKLKRSLMDAFVKIDSASHLIVLKTMPGNAQAIGALMDNLDWEEIMGTICGDDTILIICRTHDDTKVVQKKILELL

SEQ ID NO: 6686 - protein, 281 aa, Bacillus licheniformis
MTGKKERLDVLLVERGLMETREKAKRAIMAGIVYTNENRLDKPGEKVDRTIPLTVKGNPLKYVSRGGLKLEKALKEFQLSVQGKLMIDIGSSTGGFTDCALQNGALCSYAVDVGYNQLAWKLRQDERVVVMERTNFRYCTPADFTEGLPEFATVDVSFISLKIILPVLKNILVPGSDCIALVKPQFEAGRESVGKKGIVRDPLVHKAVLDDISRFAAREGYDCRNASFSPITGGDGNIEFLLHLHWDGEAQSGTPIAEETINQIVEEAHKTLKAKKPDQRD

SEQ ID NO: 6687 - protein, 622 aa, Bacillus licheniformis
MKNLSNEELESLSAEIRRFLIETLSESGGHIGPNLGVVELTIALHKEFDSPKDKFLWDVGHQSYVHKLLTGRGKDFATLRQHKGLCGFPKRNESEHDVWETGHSSTSLSGAMGMAAARDLKGTNEYIIPIIGDGALTGGMALEALNHIGHEQKDMIVILNDNEMSIAPNVGAIHSMLGRLRTAGKYQWVKDELEYLFKRIPAVGGKLAATAERIKDSLKYLLVSGMFFEELGFTYLGPVDGHSYDELFENLQYAKKTKGPVLLHVITKKGKGYKPAETDKTGTWHGTGPYKIDTGDFVKPKAAAPSWSSLVSETVRKLAREDERIVAITPAMPVGSKLEGFASEFPERMFDVGIAEQHAATMAAGLATQNMKPFLAIYSTFLQRAYDQVVHDICRQNLNVFIGIDRAGLVGADGETHQGVFDIAFLRHIPNLVLMMPKDENEGQHMVNTAVKYDDGPIAMRFPRGNGLGVKMDKELKTIPIGTWEVLRPGTDAVILTFGTTIPMALAAAEELQKEGRSVRVVNARFIKPLDENMLKEILNEGLPILTIEEAVLQGGFGSSILEFAHEHQSYSPIIDRMGIPDQFIEHGSVAKLLEEIGMTKEDVIRRIRLLTPVKTHKGIGS

SEQ ID NO: 6688 - protein, 296 aa, Bacillus licheniformis
MTGKLEGFLKSRKTVIEERLPMYIKDLQAPSILKESMLYSLEAGGKRLRPILVLALLHAYGKDEEAGIPVGCAVEMIHTYSLIHDDLPCMDDDDLRRGKPTNHKIYGEATAILAGDALLTESFKMITSNMPSDVSAEKRIRLVNELISAAGAEGMVGGQILDMEAESKSVSLDELQRIHEGKTAKLLSFSVIAGAILADASEKEIEKLREFSHHIGIGFQIRDDILDLEGSEDKIGKRIGSDASNGKSTYPSLLSLEGASQKLDEHIEKAKQLISELPLEKELMYEFCDMIAARDH

SEQ ID NO: 6689 - protein, 86 aa, Bacillus licheniformis
MAEENKTNRDDLTFEEAMKGLEQIVSKLEEGDVPLEKAIDYFQEGMALSKICHEKLQNVEKQMDFILRENGELAPFSVREEEKGDR

SEQ ID NO: 6690 - protein, 449 aa, Bacillus licheniformis
MSEISFVTVTALTKYIKRKFDVDPHLEDIWIKGELSNVKIHSRGHIYFTLKDDNARIQSVMFARQNRNLAFTPENGMKVLVRGGISVYEPSGSYQLYAKEIQPDGIGALHLAYEELKKKLSQEGLFDEKYKKPIPAFPSVVGVVTSPTGAAVRDVITTIKRRYPLVKVIVLPTLVQGVNAGESIVSSIEEANRRDLCDVLIVGRGGGSIEELWAFNEEAVARAIFSSDIPIISAVGHETDFTISDFVADLRAATPTGAAELAVPNMLDLLERLKTLEARMTKSMQQDLKKRQERVKNLQSSYAFRYPKRLYAQKEQEFDLIFDRFQKQLAMTVDRKKQKLNEQTYKLEMLHPEEQLKQARKRHEEQTVRLKRNMKVQLKQIHSQFQTVLGKLNALSPLQVMERGYSLTYKENELIKSIEQVHEKDEIRVTLNDGTLTCEVLQKRGETNG

SEQ ID NO: 6691 - protein, 284 aa, Bacillus licheniformis
MTATIIDGKETAKEKRGQLAKEVEELKKQGVTPGLAVILIGDDPASLSYVRGKKKAAEAMGIRFQLDHFDASFTEQELLEVIDQYNQNDDFHGILVQLPLPDHISEQAVIERISPEKDVDGFHPLNVGKMLLGEDTFLPCTPAGIVELLKKTEIDLSGKEVVVVGRSNIVGKPVGQLLLNENATVTYCHSRTADITAHTKKADILIVAVGKANFIKADQIKEGAVVIDVGVNRLDNGKLAGDVDFEEAKEKASYITPVPGGVGPMTITMLAHNTVKSAKRTIQL

SEQ ID NO: 6692 - protein, 129 aa, Bacillus licheniformis
MKRRTAREKALQSLFQIDVSDIEPNEAMQHALDGQESDAFFEQLVYGVLENKEKIDEMIKRHLVNWKLDRLANVDRAILRLSAYEMIFLDDIPVNVSMNEAIELAKQFGDDKSAKFVNGVLSNIKSDLE

SEQ ID NO: 6693 - protein, 136 aa, Bacillus licheniformis
MKDDNSLLEMSHEDNHLGKVEIAPEVIEVIAGIAASEVEGVAEMRGNFATGVVERFGKKNHGKGVKVDLSDDGIIIDVYCVMMFGVSIPKVANAVQDNIRQTLLNMTALSINEINIHIVGIQFDSKTHEVEIDQEM

SEQ ID NO: 6694 - protein, 450 aa, Bacillus licheniformis
MIKKLLIANRGEIAVRIIRACKELGIETVAVFSEADREALHVQMADEAFCIGPKLSKDSYLNITNIVSVAKMTGADAIHPGYGFLAENADFAELCEEVNVTFVGPTADAISKMGQRMLQGKQCSRPGVPIVPGSKGIIEDIEDAVSLARDIGYPVIIKATAGGGGKGIRVARTEEELINGIKITQQEAATAFGNPGVYIEKYIEDFRHVEIQVLADTHGNTIHLGERDCSIQRRLQKLLEETPSPALDEGIREQMGQAAVKAAEAVKYTGAGTVEFIYDYREQKFYFMEMNTRIQVEHPVTEMVTGVDLIKEQIRVASGEKLTLTQDEVTFNGWAIECRINAENPEKNFMPSPGKIEMYLPPGGLGVRVDSAAYPGYSIPPYYDSMIAKVITYGKTREEAVSRMKRALSEFVIEGVHTTIPFHLKLLEHETFVSGEFNTKFLEIYDVMGS

SEQ ID NO: 6695 - protein, 159 aa, Bacillus licheniformis
MLNIDEIRQLIKLIDESSINEFTYENEGSKVELKKQSGTVQTIQQVAAAPVQAPAPEAQAKQAPVQDAPAKEEAAKEGGNFHKITSPMVGTFYASSSPEADPYVTVGSKVTESSVVCIVEAMKLFNEIEAEVKGEIVEVLVENGQLVEYGQPLFLVKAE

SEQ ID NO: 6696 - protein, 212 aa, Bacillus licheniformis
MMLKKQTVWLLTMLSLVVVLSVYYIMSPEGENVVTVDDKEQVAAEKEKPMKEEPAKDGKDDTAPAKDKTKGKDTKDKETSASEQNGEVVTEESSGDEDLFTTYRMEMDDQRSREREELTEIVRSDKATAKEKSEAYDKMTELSEAEGTEKTLETLIKTKGYKDALVNADGDKVNITVKAKEHSKAAATDIIDIVAKEVKNLNDVAVTFEPAD

SEQ ID NO: 6697 - protein, 231 aa, Bacillus licheniformis
MNKRTWIEKLIGHLLPKDEKDGKKLTKYHYFLLLFVLGVSFMLVSQIFSSEPSQEPAADQPAASQKATSESTVQSGEGEKEVFKPASDDKPKESIQDYEQEYENQLKDILETIIGVEDVSIVVNVDATSLKIFEKNRKTQETSTNETDKQGGKRTVSEMSSDEEIVIIKNGDKETPVVVQTKKPDIRGVLVVAQGVDNVQIKKTIIEAVTRVLDVPSHRVAVAPKKMKEDS

SEQ ID NO: 6698 - protein, 209 aa, Bacillus licheniformis
MEFLTEWLTNIILFILMAIVIDMLLPNSSMQKYAKMVISLLLIVVILNPIFSLFRTDPDVIFEKLTKNGQVQSNEIKNQLNSEKKEIQASQQAYILEQMAVQLEKNAEGRFTSDKYKIDRVEVSSDSQLKTEKDLSKHAEVSVFLKPASEKTVQAVAPVEINTDRSYQSMQEREKKETGEVREQLAGIWEISPDKITVHIEGGERSGNE

SEQ ID NO: 6699 - protein, 401 aa, Bacillus licheniformis
MKRFLFWLLVIGIVCFGAHNVQASPKEAEPAGETAAEESAEAIAREQAEGLELDRVGEFWNNILTEYGGHLPESQKGSLLEFVKGEKHFSPEEWGKALFSYLFHEVLANGKLLGTLILLTIFCVLLQLLQNAFQQSTVSKVAYAIVYMVLIILALNSFRVAVTYANEAIQTMTSFILSLVPLLLALMATSGGAASAAFFHPVILFLMNTSGLFIQYIVLPLLFLSAILSIVSTMTDQYKVTQLAQLLRNAAIGTLAAFLTVFLGVISVQGASAAVTDGITLRTAKFITGNFIPVLGRMFTEATDTVISASLLLKNTVGILGVAILICIAAFPAIKILSLALIYKIAAAVLQPLGGGPVISCLDVISKSVIYIFAAMAIVSLMFFLSLTVIITAGNLTMMMK

SEQ ID NO: 6700 - protein, 121 aa, Bacillus licheniformis
MIATFLSLIVKEQKPTFAFLIVVFAGCTIFLFLVDQVYEIIRMIEKIAANANINMMYVETILKIIGIAYIAEFGAQLTKDAGQGAIASKIELAGKILILVMAVPILTVIIETIIGLIPSMS

SEQ ID NO: 6701 - protein, 68 aa, Bacillus licheniformis
MGVDVNIIFQIAGVGIVVAFLHTILDQMGKKEYAQWVTLLGFIYILFMVATVVDDLFQKIKAVFLFQG

SEQ ID NO: 6702 - protein, 171 aa, Bacillus licheniformis
MLKLLGAVLILAAATWTGFEMAKPFRERPKQIRQLLAALQSLEAEIMYGHTPLRQASKQIAHQLTEPVASLFQTFAEQLEKGSASAGTAWEDSLEKVWPETALKKKEYEILRQFGETLGRHDLISQQKHIKLALTHLETEEAEANLAQAKNEKMVKSLGFLTGLLLILLLM

SEQ ID NO: 6703 - protein, 307 aa, Bacillus licheniformis
MHHITEILPDTIKRALSGLGDHEIDQIEEIRVRTSRPLELVNKGKPRFLPYVATPEDSALLLNRLGNYSMYTLEEELKKGYVTIRGGHRVGLAGRVVVENGAVKGIREISSFNIRIAKEKIGISKPYVPHLFQNSWLNTLIIGPPQTGKTTLLRDLARLISSGSGNAPAKKVGIVDERSEIAGCVNGIPQYRLGDRADILDACPKAEGLMMMIRSMSPEVMIADEIGRMEDAEALLEAVHAGVTVIVSAHGYTYADLARRPSLKMLQEHRVFERIVELSRKNGPGSLSRILNGNGEPLGAAKRMLSC

SEQ ID NO: 6704 - protein, 93 aa, Bacillus licheniformis
MKLFFGQVNPTVLTMAALRVVSSLIELTAAVVMLLTNDVRKAVAVNSVLAMVGPLIFIITMTIGIYQIAGQLSYAKLILIFMGVVLIIAGIYK

SEQ ID NO: 6705 - protein, 185 aa, Bacillus licheniformis
MISVNDFRTGLTIEVDGGIWRVVDFQHVKPGKGAAFVRSKLRNLRTGAIQEKTFRAGEKVARAQIETKTMQYLYANGDQHVFMDTTSYEQLELNEKQIEHELKFLLENMSVQIMMYQTETIGIELPNTVELKVVETEPGIKGDTASGGTKPAKTETGLVVNVPFFVNEGDTLVVNTSDGSYVSRA

SEQ ID NO: 6706 - protein, 353 aa, Bacillus licheniformis
MKLNKLRELFGGLGIDGILVTSGVNLRYITGFTGSSGLAVISDDQAVFITDFRYTEQAKDQIKSFDIVQHAGGIVQKTAEVIKEMGINKIGFEQDKMTYGTYAAYKEQLGAAELVPVSQSVEKLRLIKSSEEIKILKEAAKIADDAFSHILTVIKPGITEIEVANELEFYMRSQGADHSSFDMIVASGVRSSLPHGVASGKAIEKGDLVTLDFGAYYKGYCSDITRTVAVGEPDDELKRIYQTVFEAQAIGMRSIKPGITGKQADAYTRDYISSQGYGDYFGHSTGHGLGMEVHESPALSARSDQMLEKGMVVTVEPGIYIPGKGGVRIEDDIVLTEEGNESLTHSAKDLIIL

SEQ ID NO: 6707 - protein, 145 aa, Bacillus licheniformis
MPHILILNGPNLNRLGKREPDVYGTDTLTDLEQRLFQFAEGIQTELTFFQSNHEGDLIDALHEAEEQYDGIVLNPGAFSHYSYALRDAVAAISIPVIEVHLSNPHAREEFRHRSVIAPVARGQITGLGFEGYKLAISYFMNTNNK

SEQ ID NO: 6708 - protein, 178 aa, Bacillus licheniformis
MGNEDNQKQPEELEQNKRETPMTFTGRVIMTGFVGGVLWSALGELAYLFKFSEVNANMILQPFVIGDWKNGFLGTFISILLIGVISIGAALLYYGTLKQVRGMWAGIVYGAVLWAVVFYLFNPMFPDVQTVAELKRETIVTTLCIYLLYGLFVGYSISFEYNELNSEKLTRALGETRE

SEQ ID NO: 6709 - protein, 317 aa, Bacillus licheniformis
MSNQTKQPAYGGQAVVEGVMFGGRRHYVTAIRRKDGSIEFFKLPRKTNPTLEKLKKIPFLRGIIAIVEASANGTKHLNFSSERYDLDPSLDDQLKEEKPSNLTMIFGLAAVGVLSFLFGKFIFTLVPVFLAELTRPVFQSDVAQIMIESFFKLLLLLSYIYAISCTPFIKRVFQYHGAEHKVINCYEQNLPVTVENVQRQSRLHYRCGSSFILFTVIVGMFVYLLVPTDPLWVRILNRLALIPVVLGISFEVLQLTNKLRDIPVLKALGYPGLWLQLLTTKEPSDDQVEVAIASFNELLHMETKAEDEQKEPSNIVM

SEQ ID NO: 6710 - protein, 128 aa, Bacillus licheniformis
MKQRVHPVSALIIAFGIFGFVYFAVTSPGRLLQYLLVFAAVGAIIYFVIRRISNRNMGSEGAAFKKAAKQSNKRFQDHKKRSVKGRVNHLRSVPSINKSKPVLVKKKSQTQLTVIEGKKSKKKNRAFF

SEQ ID NO: 6711 - protein, 291 aa, Bacillus licheniformis
MYIDGVFSGGGMKGVALVGAYEALEKRGFRFKRLAGTSAGSIIASFIAAGYTSAEIRQMMEELNESELLDPRFSLLPLKLLQWASIYWRLGLYKGDKLENWISEKLKAKGISVFGDLEQGKLKLIASDLSNGKMLVLPDDLNRYGLNPGRFSVARAVRMSCSIPYFFEPVKLKSPLGISVVVDGGVLSNFPMWLFTTEKKRPVLGITLMPNEKERPKKTIKNAFELFGALFETMKEAHDARHIATKHERNIIFLPVEEVLSTEFAMSAEKKLALIELGKKRTELFLKQWTF

SEQ ID NO: 6712 - protein, 142 aa, Bacillus licheniformis
MTTPSMEDYIEQIYMLIEEKGYARVSDIAEALAVHPSSVTKMVQKLDKDEYLIYEKYRGLVLTPKGKKIGKRLVYRHELLEQFLRIIGVDEEKIYDDVEGIEHHLSWNSIDRIGDLVQYFEDDSKRIDDLRSVQKRNEQENQ

SEQ ID NO: 6713 - protein, 278 aa, Bacillus licheniformis
MEKETWRFIDSGRRDPAFNMALDEALLFWHSENKIPPTIRFYGWNPPTLSVGYFQNIEKEINLDAVKKHGLGFVRRPTGGRGVLHDQELTYSVIVSEEHPEMPKTVTEAYRVISEGILEGFRELELDAYFAIPRTEKEKQSLKNPRSSVCFDAPSWYELVVEGRKVAGSAQTRQKGVILQHGSILLDLDEDKLFDLFIYKNDRLRERMQRNFKQKAVAINELTKEKVTIEEASEAFKKGFEKGLNIHLEPYELTEEETEFVEDLARTKYATDEWNYRR

SEQ ID NO: 6714 - protein, 128 aa, Bacillus licheniformis
MSTSSIVVLLICAALIIYAVASYIYQQRIMKTLTEEEFRAGYRKAQLIDVREPNEYEGGHILGARNIPLSQLKQRKSEIRPDKPVYLYCQNNVRSGRAAQTLRKHGCKEIYNLKGGFKKWGGKIKTKN

SEQ ID NO: 6715 - protein, 294 aa, Bacillus licheniformis
MWKKIAGIGTAAVLTLGLAACGSSNNNENASVGDQVNYKITGIDPGAGIMNATDQALKDYDLSKWTVTSGSSSAMTAALKKAYDKKDPIIITGWTPHWMFAKYDLKYLKDPKGSYGDAEEIHTVTRKGFKDDHPGANKLLSQFSWTEDDMGEVMLAVQEGKKPEEAAADFVKKHQDLVKKWTKGVDKADGEKIKLGYVAWDSEIASTNVIAKVLEDLGYNVTLSQVEAGPMWTGIANGSVDASLAAWLPQTHKTYAEKYKGKYEDIGTSMTGVKIGLVVPTYMKDVNSIEDLKK

SEQ ID NO: 6716 - protein, 284 aa, Bacillus licheniformis
MFTLSSLPRIPLADWIDQFVDWLTVSFGGVFNGIASGVESFVDEIVQGLGFVPPVMLTVIFAALVWLISKRGIALFTLIGFFIIDYLGYWDAMLQTLALVVTSVLISVIIGIPVGIWGSQKKTVRRVVTPILDLMQTMPAFVYLLPAIFFFNIGVVPGVVASVIFAMPPTIRMTILGIQQVPEDLIEATEAFGSTTSQRLFKVQLPLATKTILAGINQSIMLALSMVVIASMVGAPGLGEEVYRAVTQLQTGTGVETGLAIVIIAIVLDRVTQNIKLKKSRGNA

SEQ ID NO: 6717 - protein, 415 aa, Bacillus licheniformis
MNSDEKRIKIKVEKVSKVFGKNTKKATQLLADGKTKKEILKETGATVGVNQADFSVYEGEIFVIMGLSGSGKSTLVRLLNRLIEPTAGHVHIDGDMITNMSKDQLREIRRKKISMVFQKFALFPHKTILENTEYGLELQKVDKRKRRLKAMESLKLVGLEGYEQQYPDQLSGGMQQRVGLARALTNDPDILLMDEAFSALDPLIRKDMQDELLDLHESVGKTIIFITHDLDEALRIGDRIALMKDGNIVQIGTPEEILMNPSNEYVEKFVEDVDLSKVLTAGHIMKRAETVRVDKGPRVALTLMKNLGISSIYAVDKHNRLLGSVDAETAKKAAEKSQTLESVISREITTVEENVVLTDIFELVSDASIPIAVVDEKQRMKGIIVKGALIGALAGNDRYINAHEPAHEAVIQEVR

SEQ ID NO: 6718 - protein, 485 aa, Bacillus licheniformis
MNNQDQSLIFEVSKEGRVGYSLPELDVPETDVTDVIDEAYIRDEPADLPEVSELDIMRHYTALSRRNHGVDSGFYPLGSCTMKYNPKINEKIARIPGFSAIHPLQDEATVQGALELLYDLSEHLEEITGMDEVTLQPAAGAHGEWTGLMMIRAFHEANGDHKRTKVIVPDSAHGTNPASATVAGFETVTVKSNDDGLVDLEDLKRVVDEETAALMLTNPNTLGLFEENILEMAEIVHSAGGKLYYDGANLNAVLSKARPGDMGFDVVHLNLHKTFTGPHGGGGPGSGPVGVKKELIPYLPKPVLVKKDGRYTFDHDRPHSIGRVKPYYGNFGINVRAYTYIRSMGPDGLKEVTENAVLNANYMMRKLAPYYDLPFDRHSKHEFVLSGRRQKKLGVRTLDIAKRLLDFGFHPPTIYFPLNVEECIMIEPTETESKETLDAFIDTMIQIAKEAEETPEVVQEAPHTTVVKRMDETKAARKPVLRYEK

SEQ ID NO: 6719 - protein, 448 aa, Bacillus licheniformis
MKHRYLPATDQDKKEMLEAIGVERIDELFSDIPESVRFKGEYQIKKAKSETELTKELTKLAAKNKDTVTYASFLGAGVYDHYQPVIVDHVISRSEFYTAYTPYQPEISQGELQAIFEFQTMICELTGMDISNSSMYDGGTALAEAAMLASGHTKKKKIVVSETVHPESREVLKTYAKGQYIDVVEVPSKNGTADLEALDEAVCEDTAAVIVQYPNFFGRIEPLKDIKPIAHKGKSMFIVSANPLALGLLTPPGALGADIVVGDAQPFGIPAAFGGPHCGFFAVTKKLMRKVPGRLVGQTEDENGKRGFVLTLQAREQHIRRDKATSNICSNQALNALAASVAMTALGKKGVKEIAWQNLQKAAYAKEAAKRAGLEVAFEGPMFNEFVIRLNEPVEKANERLLEKNIIGGYDLGASYPDLKRHMLIAVTELRTKEEIDTLMNELGDCHE

SEQ ID NO: 6720 - protein, 364 aa, Bacillus licheniformis
MLKRTPLFDLYKEYGGKTIDFGGWELPVQFSSIKEEHEAVRTKAGLFDVSHMGEVEITGTDSLPFLQKLLTNDVSTLKEGGAQYTAMCYEDGGTIDDLLVYKKAANVYMLVINAANIDKDVDWMNKHIKGDVSVRNVSDEIALLALQGPKAEAILKQVADHDLAELKPFMFRDDAAVGSVQALVSRTGYTGEDGFEIYCRNEDAACIWKLLLETGKDSGLVPCGLGARDTLRFEAKLPLYGQELSKDITPIEAGIGFAVKTNKASDFIGKAVLASQKEHGADRKLVGLEMIDKGIPRHGYAVYYQGEQAGEVTTGTQSPTLKKNVGLALLKKEACALDTVVEVEIRNKRLKAKIVKTPFYKRQP

SEQ ID NO: 6721 - protein, 559 aa, Bacillus licheniformis
MRPDIHFDNEWPEQFKKHLDEDGPWANWELYQLSCEVQKRLAIPTFEGLQAPYHLPGFTPLPHQLEVARKVVEQMNGKAILADEVGLGKTVEAGLILKEYMIRGLAKKILILVPASLVSQWVKELREKFLIPAVEQKKSYVWEQCDVVVSSLDTAKRSPHRETVLSIQYDVVIIDEAHKLKNNKTKNYEFVRSLKKKYCLMLTATPIQNKIDEIFNLVSLLKPGHLGNESNFNKDYTKQINSAEAHERLKSLINKVMIRNRRHDTGITWTKRHVETVPISFSPTEQALYDEIKKLKTNHQHSSSMFSIMTLERECCSSREAVYMTLKNMLDRKDREAPVISEPVIHHLIEKVNEVAQNSKALKVVELIQELDDKVIIFTEYRATQIYLQWFLQQNGISSVPFRGGFKRGKKDWMKDLFRGKVQVLIATEAGGEGINLQFCNKIINYDLPWNPMRLEQRIGRIHRLGQERDVYIYNMATKHTVEEHILKLLYEKIHLFEKVVGDLDDILTKIEVGNFEEHLHDILFYSATDEEMKIKMENLTSFISYGNEDVSNHTQIGG

SEQ ID NO: 6722 - protein, 264 aa, Bacillus licheniformis
MRQEEIYLFLERFFTANGCTITDKSPGHMTVQLTVEVDKQIMNRPFYWHWLEKTGGEPNPMKITLITNEDEAPSDIEGEFIHFGSPRLFQIFQAVQKNGKFIRLYEKIRSEGAHIPLEPWLGMNVTISYQSDMKKDKLLSLGLHLISGQLTESFQEQMEARELSSQISDYCYTMSPLIKPESGIKRLERYIEQAARSEPLDWAEASLKRWNNDLALLNQFYEDTEEKPEEYEIEKKALQTLYEPKIDIKVQNGGLFYLRKKNSG

SEQ ID NO: 6723 - protein, 58 aa, Bacillus licheniformis
MNKDKNEKEELDEEWTDLIKHALEQGISPEEIRIFLNLGKKSSNPSTSIERSHSINPF

SEQ ID NO: 6724 - protein, 111 aa, Bacillus licheniformis
MIGQRIKQYRKEKGYSLSELAEKAGVAKSYLSSIERNLQTNPSIQFLEKVSAVLDVSVHTLLDEKDETEYDGQLDSEWENLVRDAMASGVSKKQFREFLDYQKWKKRQEKE

SEQ ID NO: 6725 - protein, 264 aa, Bacillus licheniformis
MGTKKKLGLGVASAALGLALVGGGTWAAFNDIETTQATYAAGTLDLNAKDTSARVNLSNLKPGDKFTKDFEFKNDGSLAIKEVLMQVGYSNFVDGNAKNGGKSTAEDFLKQFKVSVLTVGVEGGNGYPKNIILDEANLYDLYNMSAKKDKNAYEKVKKAIEPEFLHDNGKINVATINGKTAPEYDGIPKDPYDFDKVQLVIEFVNDKTTDASGRMVQNKYQGDSVQLDFSFEATQWNGLTIDGKKHADEKGYVKENERAHSEDK

SEQ ID NO: 6726 - protein, 194 aa, Bacillus licheniformis
MKHVMKWISNFLYVIIFTIIIAAVIVVISTKSSGGEPQLFGYQLKTVLSGSMEPEFKTGSVIAVQKVENPGSLKKGDIITFMQDENTMVTHRIIGITKNKSNLMFKTKGDNNQNPDSDPVLAENVVAKYSGITVPYAGYLLDFASKPIGTAILLIVPGLLLILYAVITVSAALREIDQKAKAIEAAGKDQSVSM

SEQ ID NO: 6727 - protein, 242 aa, Bacillus licheniformis
MFRLSRTRRCRKRAGKNIIVFQTLLIIYLLIGLGSQLSQHTNASFHDVETYSMTMKAASTFPQDEKQWDGSDLKLQKQTKTKGTVCAPLTLFAEYKNRGSQIADSEWKWELHKLGHSKKPLEDGTVIDKGVFKKEAESSIYRIESKRAAKGGLYAFKLIRPEGHPDVKKGKPFIWSNVMELQDCNEETPKPPKKASAKPKQTEQTQTTQKSEQDIEETPKDSESVDKENRKEDNSLESGEAS

SEQ ID NO: 6728 - protein, 106 aa, Bacillus licheniformis
MLKNVILCSFLLLSSIGPLNAHAAAYETARMSKWEEKAVEEAKKRYPEAEVRLTKKVWDRKRADEAVKQYHVTLSEGNKNFGVFVTISFEPATHKINKVVVVEEYK

SEQ ID NO: 6729 - protein, 60 aa, Bacillus licheniformis
MKTNDYVKYMTEQLVKYMDTPKQERKEMKEKRKELKPPSRIYQWFGILPLGCIMFFKKHK

SEQ ID NO: 6730 - protein, 121 aa, Bacillus licheniformis
MKNSKGFIYPAAVFAAVICMLCASHSAALLTNQRTFAQQTKEFHIQQNLLQNGILHALSHIHEETKEKVQKQHGLISYSVSPAHQQLTRVQIQVTTASGTETSAQFQYDLRNQKITQWKEY

SEQ ID NO: 6731 - protein, 162 aa, Bacillus licheniformis
MIMKYASLLKKETAKGTVSPFCGQRGYTLLNIMFSLMVHMFVAGTMASIFHLFLSPERNGSDIHPREWTITAEQILKESRNSIDIRSAGDHQSLAMTNRQGDTVRYEQYQTVIRKRVNGKGHVPLLQHVKKMRFMIENHLLILEATSLSGKSYRTSIPLYHM

SEQ ID NO: 6732 - protein, 115 aa, Bacillus licheniformis
MFKKNKGFTTVEAVSAFGIWVMITMLLIPMLHQLSLQREASEKEEETYRILEEKISRYTLTGRFQAKEAVLYRNTSYFIEWKEKGDDYEVCISIKKRDSQRHCFTILRAKGIYPS

SEQ ID NO: 6733 - protein, 145 aa, Bacillus licheniformis
MNQKGFTLLESLTVLMIGSIMFSLLFALLPPIYEKRIVQHFVSQLEEDLLYAQQTALVRHTTVKVQFDFAGCRYIMKHSDEGSSPELVRTYSCNIAIKKSTLKPILTFNPSGVPNQGGKIVIDTQHASFILTIYLGSGKINVQKK

SEQ ID NO: 6734 - protein, 97 aa, Bacillus licheniformis
MNEKGFTLIEMLVVMLVISILLLITIPNVTKHNQSIQKKGCEGLINMVQAQITAYQMDHDGKTPNRAELESEGYIKKNLKCPNGKAIKISNGKAQAD

SEQ ID NO: 6735 - protein, 344 aa, Bacillus licheniformis
MKIKMKWPVREQADLLKKLGDMMQSGYTILDALSMLKLQLNERRRADLTFAMEKLTEGCPVFQVLEMISFHKDAVTIVYFAEQHGNLPFAFRQSGELLHRKIAQSEKLKKAARYPLFLVLTVCVIISIMKSAIVPQFSAIYESMNVETSFATTLIFYVFDHFYLFFAGLPLVAAALSLYYLCSFRHKPPEDKMAFLITIPLLGQTFKLFNSYFLSLQLSNLLQAGLSVYDSLKAFESQPFLRFHKNEAKRLIERLKQGESLEQMLAGHPFYENDLAKAVAHGQLNGHLYRELYSYSQFLIERLERKAEKWTGLIQPLIYGLTAAMILILYLSMLLPMYQMMNQL

SEQ ID NO: 6736 - protein, 354 aa, Bacillus licheniformis
MYTIESLSGRLIDEAYRMKASDIHIVPGEKEAVVRFRIDDELFQKDGLTRNECSRLISHFKFLSSMDIGERRLPQSGALTLYINREPVHLRMSTLPTIHDESLVIRLLPKMSSKPLTKLSLFPSATFKLLSFLKHSHGLMLFTGPTGSGKTTTLYSLIDYAKRHFKRNIITLEDPVESRSENILQVQVNEKAGMTYSAGLKAVLRHDPDMIILGEIRDAETAQIAVRAALTGHLVLSSMHAKNAKGAIYRLLELGVDMTEIEQTLVAVSAQRLVDIVCPFCGDSCTLYCRLSRPVRRASVFELLYGKSLNLCIEEAKGRCGGIKTDTLKMLIRKGIALGYLPSKTYERWIGHED

SEQ ID NO: 6737 - protein, 279 aa, Bacillus licheniformis
MENKHAALYEYLVKQADRITDEWLSRTASEKEKTAQQYKDFILAVSKVFAKDEQALCWNKASGCAKEIAYDRAVSQIPVTESINGFKVCRELLIDEIEQFSDEHAPDSSKKDFFIWNKQLHLMMDEVIEQFILEYEHTTKSQLKAQTEMIRELSAPVIPVSEHIGVLPLIGEIDTHRATVIIESALTQCAELHLSHLFIDISGVPVVDTMVAHQLFKVVDSTKLLGVETVLSGLRPEIAQTVVKLGMDFSHIKTEQSLAKALCNKGFCIHEDGKAEEQV

SEQ ID NO: 6738 - protein, 125 aa, Bacillus licheniformis
MEELTFYSYPSCTSCRKTKHWLKANQVDFTERHLFRETPNQDELKHILSLTTEGIDEILATRSQAFKELNLDIEELTVSEVLELLIQKPKLLRRPIIVNGDKLVVGYNPGELLKLKKHTLHRSVS

SEQ ID NO: 6739 - protein, 81 aa, Bacillus licheniformis
MNRMFRVLGFWTGIFAVMFYLGNMKDASLLFFGQTVFFVFLSYLNLTERMYIYIFGAYLTIFFAAFTYYSVFIMVPGQGGH

SEQ ID NO: 6740 - protein, 212 aa, Bacillus licheniformis
MKWRRMPLGPIQTNAYILSNDDGTCLIFDPGSESGKLNAYIKENGLKPLAVLLTHAHFDHIGAVDNVRKEWNIPVYVHKNEAEWLTDPSLNGSALLTGQTITAEKADHLIEEEGDLKIGPFTLRMLFTPGHSPGSVSYYAEEENLIVSGDVLFKGGIGRTDLPGGNQKVLMDSIHQKLLTLPEETLVLSGHGPETDIATEQEQNPFINGFTL

SEQ ID NO: 6741 - protein, 72 aa, Bacillus licheniformis
MEIYCRGSKRRGFILMLLVIIFGLVTILSALGVLRSLKQINVLGILFGGAAFLVFGWFTVMTIINSGYPTVH

SEQ ID NO: 6742 - protein, 104 aa, Bacillus licheniformis
MAIADVTIIPIGTETPSVSAYVAEIQTILEGFKKEGKINYQLTPMNTLIEGELSDLFQVIQTIHEAPFQKGIHRVATNIRIDDRRDKKTTMEGKLASVQRHFSQ

SEQ ID NO: 6743 - protein, 366 aa, Bacillus licheniformis
MRVSLLIIAALMAVAAAGCTPQHQEGSKSVHHEEPEGKRESGAAVKDKKVIALKDRHFDETAGWLDNETVIYTATDPVGGSEIKSYDIFKGTGKTIYKTDDRLIASEVNSEKGMILIQTAGNGSEMKLTLLNLQGKQLFAKKFRTHELQVDWNRFDPSLLYVTTFTKDWNYESSLIDAKEEQTEKNIAQAAFIHWTSADTFEYIKWNERDREKPAPVYSYSTADGREKKLAGDAVLLDIVGDMRLIVTPSSDQRQGTYIFSDVSSSEKKISFKLPLFSEYGSLSPMEYGYDPRHELFYTYQPNESGSLYDLISVNLKSGKREVIREKVEMLPITLSPDGDYALYGYTQDQIISLNSKTAAPLVTKE

SEQ ID NO: 6744 - protein, 374 aa, Bacillus licheniformis
MAFINIKPELKQNMERLSDILNIPEPLLISANANVSADELYFPGVSFHAGKNVQAAETYEQLQLLANQYTFEDEQWLTKTAVYDSAELKKEIGRLTECFPFVTSRIIGRSSMGQPIYELLLGAENAGKRTHMNASFHANEWITTSVLMKWLKEYCYHLCTGQTALGFSPLDIFSSTKLSVVPIVNPDGVDLVLNGPGHLGIAREALDEMNEHQPDFREWKANINGVDLNNQFPSFWEIEKQRKPPKSPSYRDYPGDEPLTEPEAAAMRDLIANEPPDRLVALHTQGEEIYWGYKGLEPPESADVIQTFERLSGYKGVRYIDSYAGFRDWFIHYYGREGYTVELGKGKNPLPLKQFDDIYCKSRGILWASCFFES

SEQ ID NO: 6745 - protein, 315 aa, Bacillus licheniformis
MNIKGKTIAAACFVLLLIAALTACGNQTESKDSSSKSKSEETITYKAENGTVKVPKHPKRVVVMADDYFGYFKTLGLNVVGAPDRVFKNPYFKGKTDGVTNIGEGNSAEKVIQLKPDLIVVWTTQGADIEKLEKIAPTVALKYDSLNSTERLKDFAKMTGTEDQAEKWLAEWDKKVAAAKSKVQKAVGNKTVSIMQTNGKEIFVFGDQFGRGGSIVYQDLGLKATKLTKEKAIDEGPGYTSISLEKLPDFAGDYIFIGPWESSGDDSAVLNTSIWKNLGAVKNQHVYKIDPVGFYFSDPISLEGQLEFITENLTK

SEQ ID NO: 6746 - protein, 632 aa, Bacillus licheniformis
MRKSFFSKISFLLIATLLMWLKTYVVYKTSFNIKIENFMQEFILFINPLSFLLFIFGIGLFFKEKNRNRFIIGASIVLTFVLLANMIFYRFYNDFLTIPVLFQTNNMGDLGSSINSLFMPADLLLIVDIAILIWLYKRQPAKTGGKATRKERAAYYLFVAAVFFFNLGISETERPQLLTRSFDREVLVKNISLYNFHIYDGLIQSKQSAQRALADSNSLTEIENYVNANRTDTNKDLAGIAKGRNVILVSLESTQSFVVNQKLNGKEITPYLNDLIKKSYSFENFYHQTGQGKTADSEFIVDNSLYPLGRGAVFFTNAGNEYTAMPEILKNHGYYSSIFHANNKSFWNRDIMYETFKYDKFYDIKSYDVNEENSVGWGLKDKEFFEQTSELMKEMPQPFYTRLITLTNHFPFELDEEDKLINEFDSKSRTLNRYFPTVRYQDEALKRFIEKLKEDGLYDNSVIVLYGDHYGISENHNEAMSQFLGREVTPFEEVQLQRVPLVIHIPGVTDKEPKTIDTVGGQIDIRPTILNLLGIDSSDQIQFGNDLFAKDKTEFTVLRDGSFITKDKVYTDGICYDKSTGEPSKDKKGCEPYIEKAKQELSYSDQIIYGDLLRFYDSERLKKQSDSKPKDE

SEQ ID NO: 6747 - protein, 324 aa, Bacillus licheniformis
MNDSWLVGVDLGGTTVKLAFVSAYGEILHKWEIPTDKSGKTVTVSIAKAIDSKLNELGKPKHILKWIGMGAPGPVNTETGIVYKTTNMGWENYPLKDHLEAETGIAAVIENDANIAALGEMWKGAGDGAKDLILVTLGTGVGGGIIVNGEIVRGQNGAGGEIGHICSVPEGGAPCNCGKSGCIETIASATGIVRIAKEKIESDHRDTSLRECLDITARDIFEAARKNDPVAGEVVDYVAGHLGMVLANLASSLNPSKIVIGGGVSKAGEILRSKVEQSFKRFVFPRAGEAAEIVIASLGNDAGVIGGAWIAKNQWLKSQAQPVL

SEQ ID NO: 6748 - protein, 65 aa, Bacillus licheniformis
MKTAYDVQLLLKQFGCYVYFGDRELELEYMMDELKEMFLSNLIEKEQWVQGVSILQNELTNIKRK

SEQ ID NO: 6749 - protein, 484 aa, Bacillus licheniformis
MKKKHAVQKNLAKNVEYLNEKLGVDKSFDMIRLDVVYADRDMSLYLVDGFVKDDIMHHLLKNLSRLTPENLEDDPLEKLIKTHIPYIEIDTEDDLDKAADQVLSGPAVLLADGVDHAIIIDARTYPARNPEEPDNERVVRGSRDGFVETIVFNTALTRRRIRDRSLRMEFLQVGRRSKTDVVICYLEDIADLESVKKLKQSLEAIDTDALTMAEKTLEEYIGGRHWNPYPTVRYTERPDTAAVHLYEGHILVFVDGSPSALITPVTFWHHLQHAEEYRNKPLAGAYLRIVRFISVLASIFLLPLWFLLSVHPDLLPDALEYIGPEKKGALPLLAQFIIIEIGVDMMRMAAIHTPSSLATALGLVAALMIGEVAVQVGLFSHEVVLYLAVAAIGTFATPSYELSIANRLARIVLLIAAGAFGPIGFVIAIFCWVIYLVRMKSFHVPYLWPFIPFDYRAFRDIAIRTPMPLKNRRPVFLDPQDPDR

SEQ ID NO: 6750 - protein, 512 aa, Bacillus licheniformis
MYSIDYLYWNFIGNLLDRDFELVQAPASFGEAWLEARGSAPYDLVRVFRKDIDFRQDLVRDLESLYERAERLRAASGQRKLSILNVYLSQEAPVDEWEDVVGHPVADKRISIVPVFIDHASAEEGLRKLAVALNMEPDELTGQMQDAGYENVEEKRAEVLAAAKAREEERRREAAVFEKGKPMFTWIFAVLQVFMFLLLEMSGGSQNTETLVRFGAKENSLLLAGEWWRLVTPIVLHIGLVHLMFNTFALLSVGAAAERVFGSFRFLVIYISAGIFGSIGSFLFSPYPSAGASGAIFGCLGALLYLAFSNRKAFLKTIGTNIIVIIILNLGLGFTISNVDNAGHIGGLIGGLLTALAVGIPGKKRPLQRLAGWVLIFVIGGGALYFGTHSAPVQENAMLHQAAKWYEEGEYEKVKDALKEAGSKPDASSDTLRLLAYSEIRLGEYENAEKRFEAVVEKDPSDHASLYSLAWLYTQRGELAKAEQSIERALAEKPDEEMYKKLRDEIKKESAR

SEQ ID NO: 6751 - protein, 57 aa, Bacillus licheniformis
MRKVTFIVVGVIAALVFFQNRYRVINFILGQNQIRHYFIHLMMRIPFFRNKFIQQAF

SEQ ID NO: 6752 - protein, 190 aa, Bacillus licheniformis
MKRSLRSEVRKRLANMPEQEFHLKAEAIHRKLFQSKQWKKASVIALTVSRNREVPTKPIIEQARLEGKTVCIPKCMPETKKMHFRSYQDESDLEVVYFGLQEPIVHKTERMEPEDIDFILVPGICYDRRGYRIGYGGGYYDRYLAGFTKDTASLAFECQVIGHVPNEPHDIPVKQVLTEDAVYNCLDTAE

SEQ ID NO: 6753 - protein, 49 aa, Bacillus licheniformis
MRVNITLACTECGERNYISTKNKRNNPDRVEFKKYCPRDKKSTLHRETK

SEQ ID NO: 6754 - protein, 370 aa, Bacillus licheniformis
MINVLLLSLENPLSSKSGAGRYVKSHLELLRNEVSFTVCTTAAGQNSNGWETLEIPLDLKAFASFEEAVAAMNFQMIKIVLEHRGQFDFVHANDGVTAPAAVYLSEVLAVPLISTVHGLESGRKKAADGYVHPYRAILERLLAEKSDQILVLSSMMKSDMQKAFSLSFEQIRVIPHPRIKSRTVKKRMKSAPYFFSYGRFVPEKGFIELLHVFQKLRSRRPDLELVIAGEGPLQSGIETIAKELGIKDSVTILPFLCEEERESWLAFCEMAVFPSSYEPFGIAVQESMAAGAAVAAGINGGWNDFVIDRVTGFRIDFSDPHKAANALAEIVGNKEQLLKVGQTAKAYIFDLHDPGYVKNMFLHHVYHTSF

SEQ ID NO: 6755 - protein, 165 aa, Bacillus licheniformis
MKRTIIGKKPFQHSIRGDSSFCNDILKITSPDHETVRLSWEISEAALSAAEAVLFENIRDVEKQILLFCVKNGERSARTIHTGAFKGEASVFPAAGNAFYKAEYRIYNSLNMSLAVLSSDCFYLGENGIHSNSSCFQHQDNQQDWTTQFSAYTRYSLIEGKERPR

SEQ ID NO: 6756 - protein, 121 aa, Bacillus licheniformis
MKVMNVEIAIIALLVVSIALIAFSYFQREPIKEVEQELETLQLSAMQEIYKLKKKMTVLEEELLDSNVVVRRPNAGISQHIAKQILSKYQNGMSVDAIAKAEHVSVEDVKAIIKDNERVLV

SEQ ID NO: 6757 - protein, 159 aa, Bacillus licheniformis
MTRQSVQAFAGGMILATAVLAGAFYLTDNGKAEASKEAQNISEADVKTYLKDNQQVSLKREEYQQLLHYKETALKQDAASQNKKEQDDAKKGSKYKLEIKSGMSTAEIADLLAKGKVISSADDFKDYVKKTGNESKIRAGKYELKRGDSLKNIVKTLSK

SEQ ID NO: 6758 - protein, 259 aa, Bacillus licheniformis
MSAVTAVKPEDVYQINDLNLWYGEHHALKNINLTIPEYEITAIIGPSGCGKSTFIKTLNLMINMVPNVKMTGEISYNGTNVLNSKVDLVELRKKVGMVFQKGNPFPQSIFDNVAYGPRIHGLKNKKELNERVEKALVDVALWDEVKDRLHSQALGLSGGQQQRLCIARALATNPDVLLMDEPTSALDPVSTLKIEELMLKLKEKYTIAIVTHNMQQASRISDQTAFFLMGELIECNDTVKMFSSPDDHRTKDYITGRFG

SEQ ID NO: 6759 - protein, 275 aa, Bacillus licheniformis
MAQVQMPVLETVRDNIGIAPFPEAKEHILEVKNLNIYYGEKRAVNDISMRIDKHAVTALIGPSGCGKSTFLRSINRMNDLIPSARTSGEIRYEGLNILDSNINVVNLRREIGMVFQKPNPFPKSIYSNITHALKYAGERRKSVLDEIVEESLTKAALWDEVKDRLHESALSLSGGQQQRLCIARTLAMKPEVLLLDEPASALDPISNAKIEELIVGLKEEYSIIIVTHNMQQASRISDQTAFFLNGDLIEYDRTEKIFMNPSEKKTEDYINGRFG

SEQ ID NO: 6760 - protein, 295 aa, Bacillus licheniformis
MNSKVTDRLATGVFGLIAAVIAAILVGLFAYIIINGVSHISLSFLTSRSSALSSGGGIRDQLFNSFYILVLTMLITVPLGVGGGIYMAEYAPANKLTDFIRVCIEVLSSLPSIVMGMFGMLMFVNLTGWGYSIIGGALALTIFNLPVMVRVTEDAIRSVPKEQKEASLALGVSKWHTIKTVLIPGAVPSIITGAILASGRVFGEAAALLFTAGLTTPRLNFADWNPFSETSPLNIFRPAETLAVHIWNVNTQGIIPDAEAIANGASAVLVLSVLIFNLAARWLGSFIHKKLTANK

SEQ ID NO: 6761 - protein, 309 aa, Bacillus licheniformis
MVQKIEKLSAKERLISSKHNRKMDEIRGRILVASCAFIMMAAAISITIFLGNKGLQSFLANGVSPIEFLTSLDWNPTNENPEYGALPFILGSFAVTLLASLIAAPLGIGGAIFMTEIAPSWGRKVLQPVVELLVGIPSVVYGFIGLTVLVPFISQFKSSGSGHSLLAGTIVLAVMILPTVTSISTDALMSLPKNLREGSYALGATRWQTIRKVLIPAALPSLLTAVVLGMARAFGEALAVQMVIGNSRNLFESLLDPAGTLTTIITLNMGHTTYGSVENNTLWSMGLVLLIMSFLFILLIRYLSSRRKL

SEQ ID NO: 6762 - protein, 305 aa, Bacillus licheniformis
MKPFKKITLMFIMSVLVVFAAACGSSSTNNNADEGKQSDKTENKASGSLTISGSSAMQPLVLAAAEKFMDENPDADIQVQAGGSGTGLSQVAEGTVQIGNSDVFAEEKEGIPAKELTDHQVAVVGMAAAVNPEVGIDDISLEDLKKVFTGKIKNWKELGGKDQKITLVNRPDSSGTRATFVKYALDGETPAEGITEDSSNTVKKLIAETPGAIGYLAFSYIKDDTVTPLSIDGVKPTAENVQKGKFPIWAYQHSYTKGEPEGLAKEFLDYLMSDDIQKSIVTEQGYIPVTDMEVKRDADGKQTDK

SEQ ID NO: 6763 - protein, 705 aa, Bacillus licheniformis
MNKKMKNEKRKSLPIRLNILFLLAFIIFTIVVVRLGMVQIVFGEDYTNEVQKQEEVDVSTSVPRGKIYDRNLNTIVKNKPMNAITYTRTSSTSQEDRLKIAKKLAEMIKIDTDKITERDKKDYWILTRPKEAEKLITDEDRKKVKDGKLKEDDLYQLQLDRITEDKLNELTDQDLKVLAIKRQMDSGYALTPQYIKNKGVTAKEMAVVSEHLDELPGVDVTSDWKRDYPYNGLLRTMIGSISDSNEGLPKSLLDHYLSLGYNRNDRVGKSYLEAEYENVLQGQKEKVKNITNKSGDIVDTEVISEGKSGKDLVLTIDVDMQKAIEKIVEDELKSAKAKHSAPLLDRAFVVMMDPRNGEVLSIAGKQLKNESGKLKVDDYALGAMTSSYAMGSAVKGATVLTGLQTGAINLNTTFLDEPLYIGKGKPKKSWASNLGTLGIQGALEKSSNVFMFKTAIALGKGQYKAHQPLDLQTKAFDTFRYYFSQFGLGVKTGIDLPNEASGYKGSQRLPGFLLDFSIGQYDTYTPLQLAQYVSTIANGGYRMKPQLVKEIREPDSKKGIGAVTQSVQPEVLNKVDMSDEYIKEVQKGFRRVMTKGTAAGQFASASYKPAGKTGTAQSFYDGPDKSKTGTSTYNTTLVAYAPYDNPEVAISVVVPWVYNDYGQRYSITNEIGRKVLDKYFELKSKQSKENTVEKNKDKIEKEATE

SEQ ID NO: 6764 - protein, 428 aa, Bacillus licheniformis
MSRIKNIIGDVELNRDLLLLLAVGGLYSLSIALSNTFVNVYLWKQSGQFVDLAIYNLSIVVMQPIIFMFAGRLAKKIDRVFILRFGVSFLAVFYLTVLLAGENAGSRLVLLGSVLGIGYGFYWLAFNVLTFEITEPDTRDFFNGFLGILNSGAGMIGPIVAGYVISRLADNTGYTVIFSLSLALFSVAVITSFFLKRRESRGRYILKKIWTERNSDPNWRSITNAHFFQGLREGIFVFLINVFVFITTKSELALGKFGLINSAVSFFAYYFATRLIKKGARKKAILMGGLVLFGALFLILFHMTYVTLLLYAVAIAIGYPILLVPYSSLTYDVIGKARYARKARIEYIVVREVFLNIGRIVSILVFLLLVSLLKEDLGIPVSLVLLGAGHTLIYYFVKDIRLTEPARETVGKDAHKQTAEPNYLEGKR

SEQ ID NO: 6765 - protein, 202 aa, Bacillus licheniformis
MAYKLPELPYAYDALEPHIDKETMNIHHTKHHNTYVTKLNEAVAGKQDLESKSVEELVANLDAVPENIRTAVRNNGGGHANHSLFWKLLSPNGGGAPTGELAEAINSKFGSFDQFKEDFAAAAAGRFGSGWAWLVVNNGELEITSTPNQDSPLSEGKTPILGLDVWEHAYYLNYQNRRPDYIKAFWNVVNWDEVARLYSEAK

SEQ ID NO: 6766 - protein, 160 aa, Bacillus licheniformis
MDVLYWIIIAAMFVIAFIGLVYPIIPSVVFIVAGFVLYGFLFTFGHYSYLFWIIEGIFTAVLFAADYITNLLGIKRFGGSRAAIWGSTIGLLAGPFVIPVAGIILGPFIGALAGEVIVHQKDLKTAARIGIGSLIGFISGVFAKSVIQLIMIGYFLYTVL

SEQ ID NO: 6767 - protein, 233 aa, Bacillus licheniformis
MRFQGIGKTILYVFLLSVIAALPNLYHISSGVVNTMNSFQSAVKEFPAFSIKDGTLQTDAKKAIESQSFGFVIVFDPSGSYETKQIEDKRNSVGILKDKFVIAIDGQVQEMPYTMLPEDMSKDDILSLVDQNKAVIVPVLCVLLFLATAAGKFIDVSVLAVIGLIIRNGQKKMLSYKQLWVMSAYSITLATVFFAIMDALEAVVPSQFLLNWFVNFIMLFLAIKETPASKAAR

SEQ ID NO: 6768 - protein, 103 aa, Bacillus licheniformis
MKRVIVLFSILLALFIVYYDLKSGTIPQNALPASTMAAEAPAASLQYKSVTVKPGQTVFSIIGNSAVPADKIAEDFEELNPNVEAGRIQAGVTYKFPVYPDKR

SEQ ID NO: 6769 - protein, 370 aa, Bacillus licheniformis
MSEITHRTKTRPVKVGPLTIGGNNEVVIQSMTTTKTHDVEATVAEINRLAEAGCQIVRVACPDERAADAIPEIKKRISIPLVVDIHFNYKLALKAIEGGADKIRINPGNIGRREKVEAVVNAAKEKGIPIRIGVNAGSLEKRILEKYGYPTADGMVESALHHIKILEDLDFHDIIVSMKASDVNLAIEAYEKAAKAFDYPLHLGITESGTLFAGTVKSAAGLGAILSKGIGNTLRISLSADPVEEVKVARELLKSFGLASNAATLISCPTCGRIEIDLISIANEVEDYIAKIKAPIKVAVLGCAVNGPGEAREADIGIAGARGEGLLFRKGEIVRKVPEETMVEELKKEIDKLAEEHYAKQAAEKEKLNT

SEQ ID NO: 6770 - protein, 123 aa, Bacillus licheniformis
MERDQNVRDRNRAGYDADLVDATLDNDEFLEETAAEVAPTYRTDNGDNGEARNDADAAGGRVTGYIALALSIISLFMLPVLLGIAGIIVGYIARRQGAAGLGAWAMGIGAVSLVLGIFITPFF

SEQ ID NO: 6771 - protein, 194 aa, Bacillus licheniformis
MLHLGIDIDGTITAQDTFVPYLNESFSLSITLEDIKEYDLTKLLNISQEDFWKWMNENEPRIYQEALLAQYAKQTLDELKKQHKLIYITARRHHLEDITYDWFEKRDIHYDHIELVGGHDKLEAVFRHEIDVFFEDHHGNATMIAKEAGIPVLLFNTPYNQLPTDSNIVRVDSWLEAAEWLKKNEKTLKAAKSM

SEQ ID NO: 6772 - protein, 143 aa, Bacillus licheniformis
MNVQEALDLLKEKGYKYTSKREDMLQLFSDSDKYLTAKNVLSALNDDYPGLSFDTIYRNLSLFEELGILETTELSGEKLFRFKCSSAHHHHHFICMVCGKTKEIELCPMEKLTDDLDGYQISGHKFEIYGTCPRCEEESTEAQ

SEQ ID NO: 6773 - protein, 286 aa, Bacillus licheniformis
MLTPFFHYEFLQNAFISGILIGLIAPLLGVFIVVRRLSLIADALSHVSLAGIAASLYAGKQFAVLAGVSPIYFGMAFSVAGSLIIERLRTVYKHYQELAIPIIMSGGIGISVIFISLADGFNTDLFSYLFGSVSAVSREDMLVIVGISAAVLIVVFSLFKELFLLSFDEEHAKASGISAKWIHFIFILIVALVIAASMRIVGTLLVSALMTLPVAASMRIAKGFKQAIFLSILFGELSVIVGLVLAYHLDLAPGGTIVMLSIFILILCISYNKVKRRIRRERTGSA

SEQ ID NO: 6774 - protein, 233 aa, Bacillus licheniformis
MQIEEGTFLGLVGPNGSGKTTLLKCILGLIKPQTGELKLFGVPLRKFKDWSKIGFVSQKANSFNTGFPASVYEVVASGLTAKLGLFRRMSKADKQKVDEAIEAVGITSLKDRNIGELSGGQQQRTFIARALVSEPKLLILDEPTVGVDQKTVEGFYKLLEKLNREKGITLILVTHDVGTVSDKVTHVACMNKHLHFHGNTEEFESMTDQDLSQFYGHDVQAISHNHHHHGGHE

SEQ ID NO: 6775 - protein, 294 aa, Bacillus licheniformis
MAKTQKQHKKESAVKKAFRIVMILIGAACAAASIELFLVPNNIIDGGIIGISLILDYLFKDNPYINFALLVVVLNIPFMFSGYKHIGKTFLISTLIGIVSLSIIETLLHHVEGVTTQPVLAAVFGGLLLGFGVGLVIRNGGSMDGTEILGILLTKKLPFSVGEFVMFVNVFIFAWASFVFGLEQAMFSVMTYYIAMKTIDAVIQGLEETKAVIIVSDQYEEISDSLLHRLGRGTTKLKGKGGYSDEDTEVIYAVVTRLEVTKLKSIVFDIDHNAFITIMDTHETRGGKFKNAIH

SEQ ID NO: 6776 - protein, 84 aa, Bacillus licheniformis
MILFQKIVLQRLNQVTADEVLKYAKQYGIQVTRKQALEVEKLVKGKNINIFNEEERNKLLKQVEAVTSKEAVQLLNQLFAQYVS

SEQ ID NO: 6777 - protein, 297 aa, Bacillus licheniformis
MLKIGSHVSMSGKHMLLAASQEASSYGANTFMIYTGAPQNTRRKKIEDLNIEAGRAHMEENGISDIVVHAPYIINIANTTNPATFELGVEFLRSEIERTSAIGARQIVLHPGAHVGAGAETGIQKIIEGLNEVIDPNQNVQIALETMAGKGSECGRTFEELAQIIDGVTHNEHLSVCFDTCHTHDAGYDVVSDFDGVLNEFDKIVGIDRLKVLHINDSKNVRGARKDRHENIGFGEIGFDALQYIVHHDQLKDIPKILETPYVGEDKKNKKPPYRFEIEMLKNKQFDEELLEKIKQQ

SEQ ID NO: 6778 - protein, 439 aa, Bacillus licheniformis
MKQTKFEMYDLKPFIIEAVHHLGFYEPTDIQKRLIPAALKGESAIGQSQTGTGKTHAYLLPLLSRIDPEKEFVQVVITAPTRELANQIHQEVLKITKFLGPDEAIRSKCFIGGTDKQKSIDKLKTQPHLVVGTPGRIADLIREQALDVHKAGSFVIDEADLMLDMGFLEDVDFIGSHMPEGLQMLVFSATIPEKLKPFLKKYMANPRYAHVEPKHITAEKIEHVLIPSRHRDKNELLLEVMTHLNPYLAIVFANTKTTADEIAAYLTDKGMKVGLLHGGLTPRERKKVMKQIGDLEFTYIIATDLAARGIDIKGVSHVINYELPDDLDFYVHRVGRTARAGTSGTAVTFYDTSDEDALVKLEQMGIVFENMRIEKGEWKKIDDRKRRQNRKRTPDETDEVAKRLVKKPRKVKPGYKKKMQTEIQKIKRQQKRKQFRKGK

SEQ ID NO: 6779 - protein, 215 aa, Bacillus licheniformis
MFQQQPMRNQPRPQAPQRPGRALMPRHPGMGMQPPQAQQRGLQQMFQPMGAAQQQAGARGGGIQGLLSKFLPGSAASGGTGAGLGGTGSGLGGIQGLANPSTISNMLGNVQKALGVAQQVTPMIQQYGPLVRNLPGMVKMFRQLNSDDTEAEDGEQQKDEPEHKTETSGEKKEEIKVSSKKPEKSKPEEIRKKQSRSAPPSAKRKTGGSKPKLYI

SEQ ID NO: 6780 - protein, 314 aa, Bacillus licheniformis
MNVIKISPRGYCYGVVDAMVIAKNAALDKSLPRPIYILGMIVHNKHVTDAFEKEGIYTLDGPNRLEILNQVDKGTVIFTAHGVSPEVRKIAEDKGLVAIDATCPDVTKTHDLIRKMKAEGYHVIYIGKKGHPEPEGAVGVAPDIVHLVETEEDVERLDIEAEKLIVTNQTTMSQWDVHDIMEKVKEKYPDVEFHQEICLATQVRQEAVSEQAKKADLTIVVGDPKSNNSNRLAQVSEEIAGTKAYRIGDLSELKLEWLDGVETVAVTAGASTPTPITKEVIRFLEQFDHEDPSTWKISHEVPLHKILPKVKAKT

SEQ ID NO: 6781 - protein, 373 aa, Bacillus licheniformis
MTKTINGHEIIQLFEQFSPKSLAVEGDKIGLQIGTLNKTVANVMVTLDVLEETVDEAIAKNVDLIIAHHPPVFRPLKHVITDQPGGRLIEKCIKHDIAVYAAHTNLDVADGGVNDMLAEALELKNTKVLVPTYEEPLKKLAVYVPKDYEEQVRTALGDAGAGHIGAYSHCAFSAEGVGSFKPLSEADPFIGKRGELERVEEVRIETVYPAGIEKSVIKAMSEAHPYEEVAFDIYPVEQNPLQKGLGRIGELNEEMTLEAFARYVKEKLDANGARMVGKSDAKVKKVAVLGGDGNKYIHHAKRMGADVYVTGDLYFHTAHDAMMIGLNVVDPGHYAEQIMKNGVAKKLTAMCREKKFDVSVFPSDTNTNPFTFV

SEQ ID NO: 6782 - protein, 237 aa, Bacillus licheniformis
MNELKLSKRLQTVAEYITKGAVVADIGSDHAYLPCYCVLNRLASAAIAGEITDGPFLSAKQQVEKLQLSSLISVRKGDGLEVIEKGEADVITIAGMGGSLIAHILKTGKDKLSGKERLVLQPNIHAHHIREWLYQEGYALINEEILEEDGKYYEVLVAEAGDRDAAYDGVSFAAGMLVGPFLVKEQNDVFIKKWSQELKHTENIYRQIEAAPPSEENRQKLLELSERIEILKEVLRR

SEQ ID NO: 6783 - protein, 147 aa, Bacillus licheniformis
MNINNIHDFNLNQENDFLTIQTKLKKHINLENPISKDALQTCAGVDLAYWEKDGEAFGVCSIIVLDFHTKRVIEKVHCAGKIAVPYIAGFLAFRELPLIIKAAKKLTIEPDVFLFDGNGYLHINHIGLRHMLRFFSKTQRSALRKLT

SEQ ID NO: 6784 - protein, 74 aa, Bacillus licheniformis
MNSNDTVTMLNEEFENDQTGEKVEGITIIVDGQFKQVLDIIKAKSDSYQNYTEIIRDALFEGVNSMTMKLRNKE

SEQ ID NO: 6785 - protein, 219 aa, Bacillus licheniformis
MNDLSNSIKSLEPINIPCGWFVKYNDLTDTHEKVEPNTKLLELEKQRYHAAVKIIKGQDEYLIHIYDNHRETIDTINVEDRRQLVKELERIIWKIEAAAFGGNFFIFEGPPDYLRLRIPQGWTVSYNKLIDIDPDQLEEDSDDWFNFTSSLLQLEHKESRLILDVGWYVDIEPSGTFYMLLIKNLDWENPLEDMETRRPEKLVDHIEAALQKAAEHQYK

SEQ ID NO: 6786 - protein, 134 aa, Bacillus licheniformis
MITYNGPVEEPIENPNDDFIRSIVFEKGEDYWKQGSGDSCFEVEGCDEWLIFFYDEPYGFFIMRHPDYLVPMNKNVEIETVEHLVGGEPMKIPSCSYVDRGLAYRIINEFTTTKSMPTFIEWVDLYEIDFDHGF

SEQ ID NO: 6787 - protein, 123 aa, Bacillus licheniformis
MIAKHRGYDSYMEDPFLDHEVKNADLKGAEIVSGLKLEIDKITVSISAIVHWTIVRWTIILIKYLKSKQLGKTPSTKSRTHFDVNSTVILESQKATIFLREVQWVPLKKSTPKTLRTCSTNSC

SEQ ID NO: 6788 - protein, 169 aa, Bacillus licheniformis
MNNIFLDNLQNKVKVGFVLTVAERVFSVISKDDERHPEGREALDKCWLWVESHAVTGDDLYELIDNADFTGISEFAEEEEDSNIARLWSLLVDAVAYTSWEAYKKEKVKHLPQALEGINKDSITIFLNSTVETGFITSKEVEKIRKGIEVYQSAKEEIPTNREAFIKLF

SEQ ID NO: 6789 - protein, 111 aa, Bacillus licheniformis
MWEHVKSLETENIAEKIYDLDLATQQDELYEYFGDYENYSEHFLPFDYVDIHEEIEGDLTMCALNRLVNGKTNNFYEKVFELYKEGGWPCGWKGTYPKGEFIVFVPSNSNE

SEQ ID NO: 6790 - protein, 169 aa, Bacillus licheniformis
MFQEWEELNDDLKSAYYLGLCEAIVPTLKQSNDFNFIKEALDACWKWLEHKNIEADDLYTYLENLDDTGILTLMQLESNEDDLDAWICIADAISYTIYKAYKYQKDEYLPETIESIDSYELFEEFHSHFSLLSKNPGQKEKAFLKFLKKEGEKKISRESIQDFLLNSVE

SEQ ID NO: 6791 - protein, 669 aa, Bacillus licheniformis
MKVFEAHSLIEAANNRKKQYETFEDQLQTLKKAFLGVADLGDDFQGKGADNIKDFYKGQAEIVDSWLKLVEAQIAFFNGVSGDIKDKKLSDSYVEVSFLDHELKNADLKATEIVSGLKLEMDKIIASISDIVDLDNWTLDDYIDKMSKAQTTRQNTIDAVNKLDESLKTEYTNLQALDSAVLGKYSGLMEATSHGKTASPMYFSLKSFHSSEIYKNTIEVENQAANYIEFKNEQAEARRLQEKQEEEANKPWDLKALDAAGTFVGEVSGYYDYKRAAEGVDPVTGEKLTDGQRVAAGAMAAAGFIPIVGWAGRAFKGGKAIYKTGKGLIAADHALDAYKASKTLNVLKMTEMGAYGLVASNGFSEAVTGKDMFGNKVSEERRKQGLIEATLSLVGAGAVAKTANHGAQTLAKTAGKNIPLAKSPKAALVQKGNNILEKVKSFQVPTNVRVYVEQPASATGHRIGTPIVRVNVEKTPVKELGIVKMVSGGGNVSKGARTGSKIDVGKADLGVLRQKWNVPKTDTVAVGKTDVEGLENLVFEGGSPKVRKEAGLPDLDSVMPDRPIKSPGKIASATRHAEEGVLNDFISKVEALGKNPAEITGTLKIHQSNPKGVCPTCIQGLNNPNVPAGVFKQFSEMFPNLTIEVTSETIQGIKPNGRLNLVIKNGEYI

SEQ ID NO: 6792 - protein, 87 aa, Bacillus licheniformis
MTTIKLKHETVIKKLEAVRAAIDALDLPNPPKAAGKNKLTYTTKCHEREQNIHQMVADYKKAVHKNIKDTKENVDLLKEQDKAIARK

SEQ ID NO: 6793 - protein, 147 aa, Bacillus licheniformis
MNQMSHASTLNHIHSTINQKLADVERRIERVKTAKKGIEKEHETGIVEIRQILHPHLNSHWTGDFANDFDGERDEAHTSMYNIVNGKYEGYISQLERKIFALEVEKHSLELAGAAAKEADHLLSLGEKAVDQLSDKIRSIKNSWSWF

SEQ ID NO: 6794 - protein, 119 aa, Bacillus licheniformis
MNRNPLIPFLLIAIMGIGLVFILSIKGLYDAKEIAGEGNKTAQEDKADASPEEIYKANCVTCHGENYEGVSGPKLKGVGDRMDTGAIKEKIEKGGNGMPGGLVPAEKLDDMAKWVSEIK

SEQ ID NO: 6795 - protein, 373 aa, Bacillus licheniformis
MADKQAHETETEFTFEQVRDQLTEAGKKRGVLTYEEIAERMSSFDIESDQMDEYYEFLGEQGVELISENEETEDPNIQQLAKAEEEFDLNDLSVPPGVKINDPVRMYLKEIGRVNLLSAKEEIEYAKKIEEGDEESKRRLAEANLRLVVSIAKRYVGRGMLFLDLIQEGNMGLMKAVEKFDYRKGYKFSTYATWWIRQAITRAIADQARTIRIPVHMVETINKLIRVQRQLLQDLGREPTPEEIAEDMDLTPEKVREILKIAQEPFSLETPIGEEDDSHLGDFIEDQEATSPSDHAAYELLKEQLEDVLDTLTDREENVLRLRFGLDDGRTRTLEEVGKVFGVTRERIRQIEAKALRKLRHPSRSKRLKDFLE

SEQ ID NO: 6796 - protein, 607 aa, Bacillus licheniformis
MGNRIPDEIVEQVQKSADIVEVIGEYVQLRKQGRNYFGLCPFHGENTPSFSVSGEKQIFHCFGCGAGGNVFSFLRQMEGYSFTEAVSHLADKYQIDLPEQVAAVSAYSTGSSDEQKMAEAHDLLKKFYHHLLVNTKEGQAALDYLLERGFKMEQIEQFEIGCALDSWDFITKFLERRGFDLALMERAGLIIRRENGDGYFDRFRNRIMFPIHDHHGTTVAFSGRTFTGEQPKYMNSPETPLFRKSKLLYHFHQARLHIRKEERAVLFEGFADVISAVTSGVKESIATMGTSLTEEHAKIIRRNVGEVILCYDSDHAGYEATLKAAEILQKKGCNVKVAMIPDGLDPDDYIKKFGSEKFKNDVIGASVTMMTFKMNYFRKGRNLSDEGDRLAYINDVLKEVSLLSGPLEQEIYIKQLANEFSISFESLKDQLSVFEKQAASRSRESSRQDSKERQAAVSRAPRRKTGLRPAHENAERMLLAHMIHDRDVIRKVLERVGFEFNLDQHRAIAAYLYAMYEEGADISIQELFKRVEDQELGQLLTDILMLQVNEELSEAELSDYVKKVLNYRNWSMIKEKEAARAEAERQKDFIKAATLAQEIVKLNRSLK

SEQ ID NO: 6797 - protein, 163 aa, Bacillus licheniformis
MEGWRISLLEKERTIFVDADACPVKDEVLKTAADFDVKVVFVASFEHFQITRKEEENWTYVDPHKEAADLYIANHVRPGDVVVTQDIGLASLLLGKKVYVMSERGYLFEENSIDHALFRRHVAQKLRRSGRYTKGPKKLVKEDRERFVKELQKILSKIEGFTY

SEQ ID NO: 6798 - protein, 270 aa, Bacillus licheniformis
MSNRTIYVVSDSVGETAELVVKAAISQFNGSSEQTNIRRIPYVEDRGTIKEVISLAEADGGIICFTLVVPEIREFLIAEAEKANVVYYDIIGPLIEKMESVYGFSAKYEPGRVRQLDEDYFKKVEAIEFAVKYDDGRDPRGILKADIVLIGVSRTSKTPLSQYLAHKRLKVANVPIVPEVDPPEELFTVDPAKCIGLKISPDKLNHIRKERLKSLGLNDKAIYANINRIKEELEFFEKIVGRIGCNVVDVSNKAVEETANIIHNMMTKRV

SEQ ID NO: 6799 - protein, 230 aa, Bacillus licheniformis
MLSTFIHNERIVSFGLKVVSTIELNKRQEHILQIVKENGPITGEHIAEKLNLTRATLRPDLAILTMSGFLEARPRVGYFYTGKTGTQLLADKLKKLQVKDFQSIPVVIHENVSVYDAICTMFLEDVGTLFVVDDNAILVGVLSRKDLLRASIGKQELPSIPVHIIMTRMPNITLCRRDDFILDIAKMLIEKQIDALPVVKDTEKGYEVVGRITKTNMTKILVGLSENEIM

SEQ ID NO: 6800 - protein, 679 aa, Bacillus licheniformis
MSNQDLLLEIGLEEMPARFMHDSMTQLGEKLESWLKEKNIAFGSVKLYNSPRRLAVLVENVAEKQDDVKEEAKGPAKKIALDENGEWTKAAIGFSRGQGASPEDLYFKDIKGTEYVFVQKFQKGQDTFSLLPELRDLVTSLHFPKNMRWGSEDLKYIRPIKWIVALFGSEVVPFSVAHVETGRTTQGHRFLGKAADLSAPSEYEATLESQFVIADPAKRKQLIVKQLDELAAEKSWDIPRDEDLLDEVNHLVEYPTVLFGSYEEEFLAIPEEVLVTTMKEHQRYFPVKDENGSLLPYFVTVRNGDSRALENVARGNEKVLRARLSDASFFYKEDQKLNIDENVRKLEKIVFHEELGSLGDKVRRTEALAERIAEVIGADQETVQLIKRAAHISKFDLVTHMVYEFPELQGIMGEKYARMLGEKEEVALAVNEHYMPRQAGGQTPSSIAGAVVALADKLDTVASFFKIGVIPTGSQDPYGLRRQASGIVQILLDRNWGISFKELAAFAGQEANSELLEFFKQRLKYVLTAENIRYDVVDAVLESTNLEPYSAVKKAAVLESAAAKPEFKETAEALARVISISKKSETSAIDASLFENPQEEELFKAYEACRQQIETLYQAKDYEGAFSELSKLKEPIEAYFDHTMVHAEDERLKANRLAQMASLAELIRSFANINAIIVK

SEQ ID NO: 6801 - protein, 295 aa, Bacillus licheniformis
MNIQEMILTLQKHWSNEGCVLLQSYDVEKGAGTMSPYTFLRSLGPEPWKVAYVEPSRRPADGRYGDNPNRLYQHHQFQVIIKPSPDNIQELYLDSLKALGIDPLEHDIRFVEDNWENPSLGCAGLGWEVWLDGMEITQFTYFQQVGGLECKPVSVEITYGIERLASYIQDKENVFDLEWTNGYTIKDLFKMAEYEHSVYTFETSDVDMLFELFATYEKEANRQMDQGLVHPAYDYVLKCSHTFNLLDAKGAISVTERTGYIARVRNLARKVAKTYYDEREKLGFPMLKEEEASHE

SEQ ID NO: 6802 - protein, 256 aa, Bacillus licheniformis
MLTKCEGIVLRTNDYGETNKIITLLTREHGKIGVLARGAKKPNSRLSAISQPFLYASFLFRKSSGLGTLEQGEMIESMRNIREDLFLTAYAAYIAELIDKGTEEKKPNPFLFELLLQSMRRLNDGTDPDIIANLIEVKMLSVMGLYPELDECVHCKSKDGTFHFSIRDNGFICHRCFAKDPYRIPLSPASARLLRLFFYFDLSRLGNVSVKQETKDELKRVIQTYYDEYSGIYLKSRRFMEQMDNMKKMLGDENKS

SEQ ID NO: 6803 - protein, 47 aa, Bacillus licheniformis
MLNFTWNVFSQTGSVDTYLLFKELEKENLERPEVLEEELAQIDFPIL

SEQ ID NO: 6804 - protein, 301 aa, Bacillus licheniformis
MTQESFKSGFVSIIGRPNVGKSTFLNRVIGQKIAIMSDKPQTTRNKVQGVLTTDTSQTIFIDTPGIHKPKHKLGDFMMKVAHNTLKEVDLILFMINAEEGYGKGDEFIIERLKGVKTPVFLIVNKIDRIHPDELLVLIDEYRTRYPFQEIVPISALEGNNIDTLLKQIEDYLPEGPQFYPSDQVTDHPERFIISELIREKVLHLTREEIPHSIAVSIESIQERENGSVYVSATIVVERDSQKGIVIGKRGSLLKEIGKRARTDIEALLGSSVFLELWVKVQKDWRNKMSQLRDFGFREDEY

SEQ ID NO: 6805 - protein, 136 aa, Bacillus licheniformis
MTKQELIAEALKAREFAYVPYSKFKVGAALLTEDGKVYKGCNIENAAYSLCNCAERTALFKAYSEGEKSFKMLAVAADTPGPVSPCGACRQVISELCSPNMPVILTNLNGQVKEMTVQELLPGAFSSEDLHDTGKL

SEQ ID NO: 6806 - protein, 149 aa, Bacillus licheniformis
MSFSNAFTGIIKTFISERNFRIHCGAAILVIACGFFFRLTLIEWTVILILIGGMLALELMNTAVEHTVDLFTKENPPACKSCKGRGSRGGLRVCSRFVYDWVTYLFVKIVLMPALRRALFLQKFYICDLGVKKKPFLCKIKVLAVPSLL

SEQ ID NO: 6807 - protein, 158 aa, Bacillus licheniformis
MSLILDITDETGRVPEDRLAEIEKLLQFAAAEEGVADGAEVSVTIVNNEEIQKINKEYRGKDYPTDVISFALEEDGEGEVEIIGADMPPVLGDIIISVDKAREQAEEYGHSLMRELGFLTVHGFLHLLGYDHMTEEEEKEMFTKQKEILNRYGLSRSS

SEQ ID NO: 6808 - protein, 716 aa, Bacillus licheniformis
MKKKKRGGKFRLIRLNNGGFLPVILYAALSALMFILLFFHVRPESLDLDLFSISENTIYAPATVEDQKATANKKQEAREEVPDQYTLKKEYSDNRVDLVSSIFDIIKEVKKESAEKEKKDKQAPSEKDQIKSVEEKLTSDVTDSLSQDSVKHLLRASDGELSMTQDSVITAVNDVMSKEIRAGKLDEAKEHVTKELKGNSIPSKLKNAADEIGRFAIIPNYVYDPDKTEQKRQEAADSVQQVQIKQGQILVEENQLIDREVYRKLELTGLLSGANIFKPVGGLLLLIALFISALVYYFEKQYSSRIPKNKSLMLFSLITGIVLIVMEVISLFQQLEIGHIGYLVPIAMGVMLIKLLINERLAILSSMILSICGSMMFNQGVTGTFNYGIGTYFLISSMAGILFLGKHNARAKILQAGLFVSLINIVVLFTLQLIQNTAQTGLEMGTYLVMGAVSGIGSSVLVLGLMPFFESGFGILSTMKLLELSNPNHPLLRKILTETPGTYHHSVMVANLSEAACEAVGANGLLARVGAYYHDIGKTKRPQYFIENQMNIDNPHDKLSPQLSKNIIIAHVTDGADMLRDHKMPKELVDIAEQHHGTSLLKFFYYKAKEKGDQTTEEEFRYPGPKPQTKEAAIISVADSVEAAVRSMHNPNPERIEKLVRGIIADKLQDGQFDECDLTLKELNTIAKTLCETLKGIFHSRIEYPEANPKQKVKHT

SEQ ID NO: 6809 - protein, 319 aa, Bacillus licheniformis
MTEHLLAIHQQLESPNEAQALFGNQDSHLKLMEEELNISIVTRGETVYVTGDEETFEIADSLLASLLNLIRKGIEISERDVLYAIKMAKKQKLEFFESMYEEEITKNAKGKPIRVKTIGQREYIAAMKRHDLIFGIGPAGTGKTYLAVVKAVHELKNGRIKKIILTRPAVEAGESLGFLPGDLKEKVDPYLRPLYDALHDVLGTDHTARLLERGTIEIAPLAYMRGRTLDDAFVILDEAQNTTPAQMKMFLTRLGFGSKMVITGDITQIDLPKGVTSGLAVAKKMLLDIEGISIVELDQTDVVRHPLVARIIEAYEKSK

SEQ ID NO: 6810 - protein, 398 aa, Bacillus licheniformis
MKNKWLSFFSGKIQLKITGKGIERLLNECTRRNIPMFNVKKKKDAVFLYIPLSDVHAFRKVIRGFDCKCRFIKRKGFPFLVQKSKRNSGFTFGVAAFFIIMFLLSNMLWKIDITGANPETEHQIRQQLDQIGVKKGRFQFSMLTPEKIQQALTKRVENITWVGIELNGTALHMKVVEKNEPDKEKYIGPRHIVAKKGATISKMFVEKGEPLVTVNQHVEKGQMLVSGLIGSEEEKQKVGAKGKIYGETWYKSTVTVPLETSFDVFTGKVRTSHKLSLGSFSVPIWGFSFKKEDFSRPKTETEKHSLHFMNFKLPVAYEKEHMRESEQIKRVYSKKEAVLEGIEMGKRDIRKKIGRDGNIISEKVLHETSENGKVKLIILYQVIENIVQTTPIVQETKE

SEQ ID NO: 6811 - protein, 93 aa, Bacillus licheniformis
MAQRKNRIKAWLTRTLEIPPDVMMDLPRITMIGRLHIYIENHRGLLLFSDTEVRLMLKQGQCIIQGKDFVIKTILPEEILLEGTIELVRYIDS

SEQ ID NO: 6812 - protein, 149 aa, Bacillus licheniformis
MLDILFDNPIIMAAIIAAISFIFNKLGKNDENEEAKRKPAPEQQRTQTPKPKQTAQHRPAKNKNQRPAAAAANSADMEAELRRIKEDAERSMPAVERTIKKQSSRVINRKQELLDMNKKTIVQGIVLSEVFGPPRSRKPHYTMRRRPKI

SEQ ID NO: 6813 - protein, 330 aa, Bacillus licheniformis
MDPSTLFLLLIIAAGIILLAVFFTFVPVMLWISALAAGVKISIFTLIGMRLRRVIPNRVVNPLIKAHKAGLDVAINQLESHYLAGGNVDRVVNALIAAQRANIELTFARCAAIDLAGRDVLEAVQMSVNPKVIETPFIAGVAMDGIEVKAKARITVRANIDRLVGGAGEETIIARVGEGIVSTIGSSDNHKKVLENPDMISQTVLSKGLDSGTAFEILSIDIADVDIGKNIGAILQTDQAEADKNIAQAKAEERRAMAVAQEQEMRARVEEMRAKVVEAEAEVPLAMSEALRSGKIGVMDYLNMKNIDADTDMRDSFGKMTKDQNEEDHK

SEQ ID NO: 6814 - protein, 403 aa, Bacillus licheniformis
MSFRSKKPLKKAFKILERSFQEAEDMYAKHIILDINTPGGAVDAVLDMADTIHNSDIPVTAYVNRRALSAGAYLALNADDIYMAPGGKMGAAAIIDTQGNAADKKSESLWLAEMEDAAKKNGRDPKYALAMADADVDAKEVGAPKGELLTLSPDKALKVGYSEGTVSSLDDLLKKLNLKDAKIERAEVSFAEKVARFITHPVVIPILLSIGSLGLIVELYSPGFGIPGFMGLTALLLFFYGHLVAGLAGMETILLFAAGIILIILEIFLPGGIAGIAGLIAIVASLFLASGSFKVMAVSILIATAVSIAASILLTRVLGKRMKFFKKLILTDSTSTESGYVSNESRRDLIGKIGVTYTPLRPSGTVIIDDERLDVVSEGSFTAKDKKVKVVKVEGSRIVVREL

SEQ ID NO: 6815 - protein, 148 aa, Bacillus licheniformis
MSLLERLNQDMKLYMKNREKDKLTVIRMVKASLQNEAIKLKKDRLTDDEELTVLSRELKQRKDSLHEFSNANRSDLVDKVQKELDILEAYMPEQLTEEELLDIVNETIAEVGASSKADMGKVMSAVMPKVKGKADGGLVNKLVSKQLS

SEQ ID NO: 6816 - protein, 78 aa, Bacillus licheniformis
MFICMSFFKAVDWCIRREGKRMSKTVVRKNESLEDALRRFKRSVSKTGTLQEARKREFYEKPSVRRKKKSEAARKRKY

SEQ ID NO: 6817 - protein, 311 aa, Bacillus licheniformis
MMILILFVLLIVLFLKGMSMLRKGLISLTFEKIEKRLLFFTDHPVKAFLVSIIFTGILQSSSAFMVIVIGFVSVGALSFKRSIPLILGTNIGSTFTTEFLAVKLEFLIFALLAAGAALFIAGKSPFRQVGVSMIGLGVIFFCISGFSRLAVPLSQLDSGAYIVQLAEDSSLYALFIGTVLTAMIHSSSACVGILMSFMDQGVVGLTEAMSVVLGSNIGTCITAVMASFKGGAAARQTAYAHVLFNVIGVAAVYPLLSSITGFISGLSESPAQQIAHFSLLFNVVTSLLFLPLSNLFHSLIMFLIPNKNQAR

SEQ ID NO: 6818 - protein, 223 aa, Bacillus licheniformis
MTKQIARMIDHTALKPDTVKSEIEALCKEARVYGFASVCVNPCWVKLCAELLKESEVKVCTVIGFPLGAASPETKAFETRQAIADGAGEVDMVINIGALKDRDTGTVEHDIRAVTDAADGKALVKVIIETSLLTDEEKRLACELAVKAGADFVKTSTGFSGGGATVRDIKLMREAVGPDIGVKASGGVRDKESALAMIEAGATRIGASAGVSIVKGLTADEDY

SEQ ID NO: 6819 - protein, 451 aa, Bacillus licheniformis
MATVAFHTLGCKVNHYETEAIWQLFKEAGYERKEFESSADVYVINTCTVTNTGDKKSRQVIRRAIRQNPDAVICVTGCYAQTSPAEIMAIPGVDIVVGTQDREKMLGYIKQYQEERQPINGVSNIMKARVFEELDVPAFTDRTRASLKIQEGCNNFCTFCIIPWARGLLRSRDPEEVIRQAQQLVDAGYKEIVLTGIHTGGYGEDMKDYNFAQLLKELDSRVKGLKRIRISSIEASQITDEVIEVLDRSDKIVRHLHIPLQSGSNSVLKRMRRKYTMEFFADRLTKLKKALPGLAVTSDVIVGFPGETEEEFMETYNFIKEHKFSELHVFPYSKRTGTPAARMDGQVDENVKNERVHKLIALSDQLAKEYASDYEGDVLEIIPEEPFTETGEGNLLVGYTDNYIKVVFEGSEDLIGQLVKVKILKAGYPYNKGQFVRVAEDDVRENIRLSS

SEQ ID NO: 6820 - protein, 255 aa, Bacillus licheniformis
MQRYFIEQSKQEVTAAPAFSIKGEDVHHIATVMRMSPGDEVICCAKDGHEAKCRIESVTKEEVLLSVIEWTGETRELPVQIHIANGLPKGDKLEWIIQKGTELGASSFIPFQASRSVVKLDEKKAKKKRERWAKIAKEAAEQSHRNAIPDVAPVHTFQRLLESLEDFDKCVVAYEESSKQGETSRFQSVLKSLSEGSSVLMVFGPEGGFTEEEIEALKEKGALACGLGPRILRAETAPLYALAAVSYHTELLRGE

SEQ ID NO: 6821 - protein, 311 aa, Bacillus licheniformis
MKWSEICIHTTHEAVEPISNILHEAGASGVVIEDPLDLIKERENVYGEIYQLDPNDYPDEGVIIKAYLPINSFLGETVEGIKETINNLLLYDIDLGRNKITISEVNEEEWATAWKKYYHPVKISEKFTIVPTWEEYTPVHTDELIIEMDPGMAFGTGTHPTTVLCIQALERYVKEGDSVVDVGTGTGILSIASAMLRAKQVEGYDLDPVAVESARLNSKLNKVSDHIEIKQNNLLDGVEGEKDIIVANILAEVILRFTDQAYSLLKDGGYFITSGIIQQKKQEVKDALVKEGFTIVEVLSMEDWVSIIAKK

SEQ ID NO: 6822 - protein, 375 aa, Bacillus licheniformis
MSKRDYYEVLGVGKSASKDEIKKAYRKLSKKYHPDINKEAGAAEKFKEVKEAYETLSDDQKRAHYDQFGHTDPNQGFGGGGFGGGDFGGFGFDDIFSSIFGGGARRRDPNAPRQGADLQYTMTLSFEEAAFGKETTIEIPREETCETCSGSGAKPGTKPETCSHCGGSGQLNMEQSTPFGKVVNRRVCHYCNGTGKQIKHKCSTCGGTGKVKKRKKINVTIPAGVDDGQQLRVAGQGEPGINGGPSGDLFVVFRVQEHEFFERDGDDIYCEMPLTFAQAALGDEIEVPTLHGKVKLKVPAGTQTGTKFRLKGKGVANVRGYGQGDQHIVVRVVTPTNLTENQKNILREFAEVSGNMPDEQEMSFFDKVKRAFKGD

SEQ ID NO: 6823 - protein, 653 aa, Bacillus licheniformis
MSKVIGIDLGTTNSCVAVLEGGEPKVIPNPEGARTTPSVVAFKNGERQVGEVAKRQSITNPNTIMSIKRHMGTDYTVEIEGKKYTPQEVSAIILQHLKSYAESYLGETVSKAVITVPAYFNDAERQATKDAGKIAGLEVERIINEPTAAALAYGLDKTEEDQTILVYDLGGGTFDVSILELGDGVFEVRSTAGDNRLGGDDFDQVIIDHLVSEFKKENGIDLSKDKMALQRLKDAAEKAKKDLSGVSSTQISLPFITAGEAGPLHLELTLTRAKFEELSSHLVERTMGPVRQALQDAGLSASEIDKVILVGGSTRIPAVQEAIKKETGKEAHKGVNPDEVVALGAAIQGGVITGDVKDVVLLDVTPLSLGIETMGGVFTKLIERNTTIPTSKSQVFSTAADNQTAVDIHVLQGERPMAADNKTLGRFQLTDIPPAPRGVPQIEVSFDIDKNGIVNVSAKDLGTGKEQNITIKSSSGLSDDEIERMVKEAEENAEADAKKKEEIELRNEADQLVFTTEKTLKDLEGKADEAQVKKANEAKDALKAAIEKNDLDEIKAKKDELQAIVQELSMKLYEEAAKQAQAQQDGGAGAKKADDNVVDAEYEEVNDDKRSKIIEIKCAVLTPVCTAHDLTGDESQSQDLLTLTFFFLKDKRN

SEQ ID NO: 6824 - protein, 99 aa, Bacillus licheniformis
MLPALDNFERALQIDPDNEQTKSLLQGMEMVHRQILEALKNEGVEQIPSVGEQFDPNMHQAVMQVEDEAYESNAVVEELQKGYKLKDRVIRPSMVKVNQ

SEQ ID NO: 6825 - protein, 48 aa, Bacillus licheniformis
MADDKQNEELNEQEELTETEAETVESEQTAAEADAPAEETQTKCLKNN

SEQ ID NO: 6826 - protein, 343 aa, Bacillus licheniformis
MLTNRQLLILQVIVNDFIRSAQPVGSRTLSKKEDITFSSATIRNEMADLEELGFIEKTHSSSGRIPSEKGYRYYVDHLLSPGKLSKTDLNIIHSIFKEKIFELEKAVQKSAQVLSDLTNYTSIVLGPRLSENHLKQIQIVPIQPKKAVAILVTNTGHVENKTINFPAEVDLSDLEKLVNILNERLRGVPISELKDRIFKEVVIFLKSHIQNYDTILHALGATLDSSVQTDRLFFGGKINMLNQPEFHDIDRVKSLLSLIEKEQEILRLFQSTESGITIKIGKENDYEEMENCSLITATYTVGSKQIGSIAVIGPTRMDYSRVVGLLQHVSSDLSKALTSLYDG

SEQ ID NO: 6827 - protein, 379 aa, Bacillus licheniformis
MKAAYIHIPFCEHICHYCDFNKFFIQSQPVDEYLRSLEKEMANSMEATGHPELKTIFIGGGTPTSLSAAQLERLLDSIHRVLKPSESLAEFAVEANPDDLSAEKLDVLKAAGVDRLSFGVQTFEDELLKKIGRVHEQKDVLVSFERARKAGFDNISLDLMFGLPGQTIGHLASSLDTALALGAEHYSVYSLIVEPKTVFYNLMKKGRLHLPPQDQEAEMYELVMRKMEEAGIGQYEISNYAKKGYESKHNLTYWNNEDYFGFGAGAHGYINGERTVNAGPVKHYIDLIEQSGFPYKEKHMVTKNEQIEEEMFLGLRKTEGVNKERFFETYGRSVDDLFPKVLHSLEETGLIVNTNKNVFLTHNGKLLGNEVFQAFLGEL

SEQ ID NO: 6828 - protein, 567 aa, Bacillus licheniformis
MKEQLLDSMDLERERGITIKLNSVQLKYQAKDGEEYIFHLIDTPGHVDFTYEVSRSLAACEGAILVVDAAQGIEAQTLANVYLALDNDLEILPVINKIDLPSAEPERVRQEVEDVIGLDASEAVLASAKAGIGIEEILEQIVEKVPAPSGDPEAPLQALIFDSLYDAYRGVVAYIRVVQGTVKAGQKIKMMATGKEFEVTEVGVFTPKAVPADELTVGDVGFLTAAIKNVGDTRVGDTITSAENPAPEALPGYRKLNPMVYCGLYPIDTAKYNDLREALEKLELNDSALQYEAETSQALGFGFRCGFLGMLHMEIIQERIEREFNIDLITTAPSVIYDVYMTDGEKIVVDNPSNMPDPQKIDRVEEPFVKATMMVPNDFVGAVMELCQGKRGQFIDMQYLDANRVSIVYEIPLAEIVYEFFDQLKSNTKGYASFDYELIGYKPSKLVKMDIMLNGEKIDALSFIVHRDYAYERGKVIVEKLKELIPRQQFEVPVQAAIGTKIVARSTIKAMRKNVLAKCYGGDISRKRKLLEKQKEGKRRMKQVGSVEVPQEAFMAVLKMDDSGPKS

SEQ ID NO: 6829 - protein, 107 aa, Bacillus licheniformis
MASFMGKCILACAVMFFGVLLGMQQANNGMIEMKGYEDPDLKAALSISEGDAKEASVLGHQIDLEEKQKELEQLEAFNLFSSAGRALADSVTNTARSLYDWIKEKTE

SEQ ID NO: 6830 - protein, 401 aa, Bacillus licheniformis
MRKRGRNRQFVLAVNGRSAVKTVFLFIVSLLLVFILSGVLTSLRPELRPSSSLYRVADELKGETFGLILGMENHYFASELPEPNKRFELSPLVLKLATSINLKDPRSFLGRELPGFSHFDSEILIAGQGTDYTNMPSESPPPTEVLKEEREANLAELEGKQKKKTDGEKPPEQSTGGRKVVFIYNTHNTESYLPFLKGEADPDRAIHSKANVTLVSDMLANLMKSQGVGAMVDKTDFQANLRKKGWAYARSYDESRPVVKEAMAQNKDLQYFIDIHRDSQRKKATTATVKGKSYARVAFVLGKKSSNFESNLKLAKELHERMEKKYPGLSRGVISKGAAGDNGIYNQDLNERSVLIEFGGVDNNREELERAAEAMADVFSEMYWNAEKVDADSGEDDKKKQ

SEQ ID NO: 6831 - protein, 368 aa, Bacillus licheniformis
MEKKKLDLSQYAVRTDLAVEARDLAEEKEASPKKELKGFTVKEYEKDGIKIQTMDIDEEGAKLSGKKAGRYLTFETQGIRQQDSVLQEKVVDVFAKEFSSFLDYLGIPRDASCLIVGLGNWNVTPDSLGPLVTENLLVTRHLFQLQPENVEEGYRPVSALSPGVMGLTGIETSDIIQGVIDRSKPDFVIAIDALASRGIERVNSTIQISDSGIHPGSGVGNKRKELSKDTLGIPVIAIGVPTVVDAVTITSDTIDYMLKHFGREMRDDSPSRSLVPAGMSFGKRKVLTEEDLPDEEHRKSFLGIVGGLAEDEKRQLIHEVLAPLGHNLMVTPKEVDTFIDDMANVIANGLNTALHENVSQDNKGMYNH

SEQ ID NO: 6832 - protein, 88 aa, Bacillus licheniformis
MPNIKSAIKRTKTNNERRAHNATIKSAMRTAMKQVETFVSNNEADKAKAALSAAAKKIDKAAKKGLVHKNTAARYKSNLAKKVNGLSA

SEQ ID NO: 6833 - protein, 354 aa, Bacillus licheniformis
MKEGKVQMTVFDVWKSLKKGDIHPVYCLYGKETHLLQETVQRIRQAVVDEETKDFNFSIFDLEEDALDLAVEDAETFPFMGERRLVVAKNPAFLTAEKKKDKLEHNLGVLEAYITQPAPYSVFVLLAPYEKLDERKKLTKLLKKHAHMVEAKELTAKETADFIAGLAKSEGKQIEPEAAEELVLLCHASLSAIAQEVKKLSTYTGDRGEITIEDVRKLVARGLEQNIFELINKVVNRKRTEALQIFYDLLKQNEEPIKMMALIANQFRLLMQTKYFSDQGYGQKQIASNLKVHPFRVKLAIEQARLFSEQELRNIIEQLAVMDYEMKTGKKDKQLLLELFLLKLLQPHEKNGLL

SEQ ID NO: 6834 - protein, 43 aa, Bacillus licheniformis
MNEFEKDVQSKRNDLVDSGVGFIVSFGFFATMFIIATVIHLAA

SEQ ID NO: 6835 - protein, 795 aa, Bacillus licheniformis
MDRHRIFPCGAISAAAGIASAHSSLYLFLAVGFFLFFILCFFKKQILLFALCAAVCILYFTSFYVIDHFNTTIYHEGKFHTLASVQDIPVIDGDRLSFTAETDEGEALKAGYTLRSPQEKRALSALQPGSLCVMQGELKEPKKETVPGTFNQKESMYQKGIHWIFAVQSITSCKPGGGLMPSLLKIRKAGLDFIEENMADSAAGIGRALIFGDRFLIEQDVLDGYQRLGIIHLLAISGLHVGLLSAALFYIFIRFGVTRECAKWLLVIGLPVAAVLTGGAPSVMRAVFMSEIYLLASLSKKNFKSADVISIACLGLLLYHPYLLFQAGFQLSFAVSFVFILSKEILTRPKSRISQLLLGSFLAQLASLPILLFHFQEFSFLSTLMNLFFIPLYIFIIMPLSFGSLLAFICFHPLGEAAAAVLDRLLVWSHQAVKTVSAADVSVFSAAKPPDLLLFFYFTAIFLFLLLLEKEMSLRAVMIPSGLLAAVFVIHACLPQLAGEGEVTMLDIGQGDSMYVSAPGQNGTVFIDTGGTVSFRKERWRKRKKDFSLGESVLMPFLATKGVKKLDALILTHADQDHIGEAHVLIQKHKVKQLIVPKGFAAEPSDEKLLRLALKEGVEVNVAKRGDILHIGNLEFYVLSPKEADKNSKNNGSLVLWMKAGGFSWLLTGDLEKEGEKEMMEVYPNLKADILKVGHHGSKGSTGEELIKQIEPKTALISAGEHNRYGHPHGEVLDILNRHDVKVFRTDRHGSIQHLFRGGNGTFLLHPPYDKVHSPQEKMTAEKQQSSKSRLPDGE

SEQ ID NO: 6836 - protein, 189 aa, Bacillus licheniformis
MERISWDQYFMAQSHLLALRSTCTRLAVGATIVRDKRIIAGGYNGSIAGGVHCADEGCYMVDGHCIRTIHAEMNAILQCAKFGVPTEGAEIYVTHFPCIQCCKSIIQAGIKTIYYAKDYKNHPYAVELFDQASVKVEQVELDEMIIDLKNQEKLAFVADLIKQLADKGLEEEEIRKIHEEANKLFTSYV

SEQ ID NO: 6837 - protein, 209 aa, Bacillus licheniformis
MTDWLKQYKWHAAGGVALVLIISAAFMLLSGKRETSSGLSIPEEASAQTYDKKEEVKREKSAGKEAVIIDLKGAVKNPGVYQMKEGDRVHDVLKKAGGTEKKADQKQINLAAVLQDGMVVYIPFEGEEAADSFSKAGSRADGASVDIVNINTASSEELQAIPGIGPSKAEAVIEYREENGPFHTVEDITNVSGIGEKSFERIKSAITVK

SEQ ID NO: 6838 - protein, 273 aa, Bacillus licheniformis
MNIGFIGTGNMGTILIEALIESRAVIPSSLTITNRTIDKALNIKKRFPDIQVAERPEEVITESDAVFICVKPLDIYPLLKRLSPVFTRDQTVVTITSPVQVEQLETIVSCQAARVIPSITNRALSGVSLLTFGESCTAEAKEKLTALVSKISIPLEIESEITRVASDIVSCGPAFVSYLVQEFIQAAVEETSVSKEDAILMTKEMLVGLGRLLETGLYTLPALQEKVCVKGGVTGEGIKALESGVQDMFRQMFRNTHLKYEEDIALVKKQFSV

SEQ ID NO: 6839 - protein, 251 aa, Bacillus licheniformis
MIYKGFSSIYDKLMSHAPYDQWVSWIEQTIGAQQKERIRVLDLACGTGEISVRLAEKGYDVTGIDISEDMLAQAQYKAAVRQLDIQFFQQDMRELAGHGQEFDAVAICCDSLNYLKSEKDVFNTFKNVFSLLKEGGLLLFDVHSVYKMDVIFPGSTYADQDEEVSVIWQSYAGEEPHSAVHDLTFFVQNRDVYERFDESHEQRTFQTEKYISLLRQAGFEVQCISADFSKLEPSAESERHFYTAKKTKTIV

SEQ ID NO: 6840 - protein, 118 aa, Bacillus licheniformis
MDQASILKIAAEACDDKRAEDIIALNMQGISLVADYFLICHGNSDKQVQAIAREIKDQAEENGIDVKKMEGFDEARWVLIDLGDVVVHVFHKEERGYYNLEKLWGDAPIEDLSFGVNE

SEQ ID NO: 6841 - protein, 187 aa, Bacillus licheniformis
MKREEALACVKEQLTEQRYIHTVGVMETAVKLAERFGADLKKAEIAAIFHDYAKFRPKEEMKQIILDGGGPLEVLNFHHELWHAPAGAALVKTEVGITDEDILSAIRFHTSGRPNMTLLEKVVYVADYIEPGRRFPGVEEVRTLAEEDLDSALIQALKNTITFLISKNQAVYPETVATYNALVNDRH

SEQ ID NO: 6842 - protein, 189 aa, Bacillus licheniformis
MRKIGIFGGTFDPPHNGHLLMANEVLYKLDLDEIWFMPNQIPPHKQKNSFSLSMHRVEMLKLAISGKEQFKLETIELEREGPSYTFDTVRLLKDRYPDHEFYFIIGADMVEYLPKWSNIDKLVNMIQFVGVKRPGFQIETPYPLVFVDVPIFEVSSSLLRDRIKNRQPTDYLIPDEVKVYVKENRLYET

SEQ ID NO: 6843 - protein, 96 aa, Bacillus licheniformis
MLTGKQKRYLRREAHHLSPIFQVGKGGVNENMVKQISEALEARELIKVSVLQNCEQPKEEVAEALAGGARAELVQTIGNIIVLYKESKENKKIELP

SEQ ID NO: 6844 - protein, 278 aa, Bacillus licheniformis
MKPIYGLIGNPVAHSMSPDIHNAALKDLSLEGHYHAFRVENEDLEDAVKGMRALGIQGFNVTVPHKVSIMKHLDRIDESAEALGAVNTVRREKEGLVGYNTDGAGFLKSLKPSLDRPLSELSILLIGAGGAARAIFTTLAAETPKRLDVANRTPEKALAFTQRFDGEARALSLQEAEADLSAYDIVIQTTSVGMHPNVEAAPLSLANAKETCLVCDIIYNPLKTALLHEAEAKGLKTLDGVGMFIGQAALAFELWTGHEPNMEKMKSIVLQQLGGKSC

SEQ ID NO: 6845 - protein, 366 aa, Bacillus licheniformis
MEKVVCIGCGVAIQTEDKNKLGYAPEASLLKEDVICQRCFRLKNYNEIQDVSLTDDDFLKILHGIGETDSLIVKIVDIFDFNGSWINGLNRFVGGNPILLIGNKADILPKSVKRERLVNWMKREAKELGLRPVDVLLVSAGRGQGMKDAIDAIEHYRQGKDVYVVGCTNVGKSTFINRIIKEVSGEDDIITTSQYPGTTLDAIEIPLDDGSAMYDTPGIINHHQMAHYVAKRDLKILTPKKELKPRTFQLNEEQTLFFGGLSRFDYASGGRSSFVCYMPNELKIHRTKLENADQLYEKHAGEMLAPPAKEDLDSFPALVKHTFTIKEPKTDVVFSGLGWVTVQGANQKIVAHAPKGVHVFLRRSLI

SEQ ID NO: 6846 - protein, 172 aa, Bacillus licheniformis
MLKKFFLPDEFVKNIFHITPEKLKERNVKGIITDLDNTLVEWDRPSATPRLIEWFEEMKEHGIKVTIVSNNNEKRVKIFSEPLNIPFIYKAKKPMGRAFRKAVKNMGLKKEDVVVIGDQLMTDVLGGNRNGFHTILVVPVAASDGFFTRFNRQVERRILSALKRKGHIQWEE

SEQ ID NO: 6847 - protein, 46 aa, Bacillus licheniformis
MKKLSDELLIESYIKANEMNLNREFIELIETEIKRRSLGHLLSVSS

SEQ ID NO: 6848 - protein, 51 aa, Bacillus licheniformis
MGYPFPAGPCSYPAYPGYAGAAYGYAFVVVLLVVLLVIGGFYWLSPRGFFK

SEQ ID NO: 6849 - protein, 248 aa, Bacillus licheniformis
MEVERMKKSLVMVLVFLLLLSGCGEDDPRKVVAFGDSNTRGSNWQFRDYPKAEKWVNLLQTSLQGQYKINNAGIGGETTEDARFRFRKDVLDKQPAYLFIMFGTNDAAILTKGLPRVSKKRFKENLYYFVKESRRRGIEPVLMTCLPIVEGSGDNIFYYARYRASSFEKYGGARKWHDSYNDVTRETARELDVPLIDNWKNIVKKAGGATDEKLIHSRFIDPSGNHLTPKGARIIFEGINKSKIIKTS

SEQ ID NO: 6850 - protein, 253 aa, Bacillus licheniformis
MIELKSSEKRKAKALLAEESPTFAHAIAEGIIEGNVYVDDFLTPATALFRTSSGIYYVAGNPPDSGRSEWLHYLNEQRSGARFTVFSASEEWDAFLIGGLGDPLQQMERVSFFLGKEERDCGAAFAGVERFTEDDLQKSANFTEKYADEYWGGASRFLKNGFGFKVLHGGVVASECVTIFCSERFAEVDIATHPDYRGRGFAVSCASAFIAHAIKNRLKPRWDCDRQNRASIRLAEKLGFRPVKTYSLFVGKP

SEQ ID NO: 6851 - protein, 123 aa, Bacillus licheniformis
MSKKIHEFNDMIRKLRKELFGKGPERIRTVFVDNMAVSTLYGNLTASEQFIASTPEGREMVHAARTTLIQKHYSNHVPEGMEELIGAKLEHLFTDIKIQEDIAVSVFIFDRNIEGVAESAGGA

SEQ ID NO: 6852 - protein, 979 aa, Bacillus licheniformis
MDGKPISIRIDGKEFEAVAGATVLDILNKNGFEHPQICHVPETDPIQTCDTCIVEADGKLKRACSLRAEDGMTISLSAERVKAAQKEAMDRLLENHLLYCTVCDNNNGNCKLHNTAEMMGIEDQKYPYTPKEDPSCAVDMSHPFYRYDPNQCIACGQCVEVCQNLQVNETLSIDWELERPRVIWDEGVSINESSCVSCGQCVTVCPCNALMEKSMLGKAGFMTGIKPDVMEPMIDLVKDVEPGYSSIFAVSEVEAAMRSQRTKKTKTVCTFCGVGCSFEVWTKGRDILKIQPVSEAPVNAISTCVKGKFGWDFVNSEERLTKPLIRKNNEFVESTWEEALDYVARRLGSIREQNGKDAVGFISSSKITNEENYLMQKLARQVFGTNNVDNCSRYCQSPATDGLFRTVGMGGDAGTIQDIAKAGLVIIVGANPAEGHPVLATRVKRAHKLHGQKLIVADLRKNEMAERSDLFIRPRQGTDQVWLMAVTKYMIDQGWHDQAFIDENVNFFEEYKQSLETYTLEYAEKITGIHKQTLIQIAEMIRDADGTCILWGMGVTQNTGGSDTSAAISNLLLATGNYRRPGAGAYPLRGHNNVQGACDMGTLPGWLPGYQHITDDKARKKFEQAYGTTIDEEPGLDNIEMLHAVEEGKMKAMYIVGEDMALVDSNANRVHDILSSLEFLVVQDVFLSKTAQYADVVLPASASLEKDGTFTNTERRVQRLYQALPPLGDAKPDWVIIQDIANRLGADWSYSHPGDIFSEMASLSPLFSKADYDAIEGWNSFLWGSLTGESTPLLYEDGFNFPDRKARFAIADWAEPAEFPEEYDLHINNGRMLEHFHEGNMTNKSAGIQAKVPDVFVEVSPELAKERGICDGSQVRLISPFGAVKLTALVTDRVRANELYLPMNSTDKESAINFLTGPAVDARTNTPAYKQTKVRMEVLGGCAEPPLPKTNPRNKKRHPQNGAEVERKWKRPGYVHLTD

SEQ ID NO: 6853 - protein, 159 aa, Bacillus licheniformis
MAAPITAIRKEEKSEEQIKLEKLEELKALLAEQEAAVSKTMKLLGELNGLGILDAADSMIGAKEDIAKIVLGQLSKEPAKNLMNTAIAAGGALSKAEPEVMGKLVESIVAGTKQGEDFLKSDKKTGVLDLLKAMNDPDINRAVGFGLQFLKGMGKALKE

SEQ ID NO: 6854 - protein, 80 aa, Bacillus licheniformis
MRVPDGSPYRKRYQPAGPVRQMKNKRLFILSLIVLSVVMIGVQETFPNLLTTGLMTVVIAAAVFNILKESLNKKDETHSK

SEQ ID NO: 6855 - protein, 241 aa, Bacillus licheniformis
MTGVFAALGYVIKELVFLVSYVKNNAFPQPLSSSDEKKYLELMAQGDEHARNMLIEHNLRLVAHIVKKFENTGEDAEDLISIGTIGLIKAIESYSAGKGTKLATYAARCIENEILMHLRALKKTKKDVSLHDPIGQDKEGNEISLIDVLKSENEDVIDTIQLNMELEKVKKYIDILDGREKEVIVGRFGLDLKKEKTQREIAKELGISRSYVSRIEKRALMKMFHEFYRAEKEKRKKAKGK

SEQ ID NO: 6856 - protein, 155 aa, Bacillus licheniformis
MISLVFPLILITDKTSLIWISIVLFIRCTSIGGNLPLASDAYTGLDRKQLPEAGVGINNIENPGSSFGSAVIATVGATVMEGLQPTIANSLKGYHAGFLVSTIVLAIIFIPHIKKPNKQMLTGEVYTLQEHSKLADLFHTGKLHQAEDAPVTQPN

SEQ ID NO: 6857 - protein, 174 aa, Bacillus licheniformis
MILIRKAKVSDANSIAKVHVESWKTTYQGVLPDDTLSKLSVENQAKLWRTSLSDPKNQDIVYVAEETDGKIIGFASGGPNRDHLSKYKGEVSAIYLLLQYQKKGIGSRLMKAIVEELVKKNIKSLLVWVLAGNPSINFYEKLGGRQSTTKQIQFGEDYFKAIAIGWTDINGFLL

SEQ ID NO: 6858 - protein, 116 aa, Bacillus licheniformis
MNEACQHTKKYKGTITNNVSAGTLVGAAISLTGIDKGSCEQSKTNSFDHNFISCSNEELLQELTEITPVEESMEISILIQDPETNVAYYINSGKLIKYKCNLPEFWGRYTSGSSSS

SEQ ID NO: 6859 - protein, 45 aa, Bacillus licheniformis
MSSGSENEDVIDTIQLRHRPEKVKKYNDILDGREKEVIAGASALI

SEQ ID NO: 6860 - protein, 410 aa, Bacillus licheniformis
MSPNHHKLFYKDPYLKTFETKILKQQQDKKGDVYIILEETAFYPTGGGQPHDTGTLNGVKVLNVDEIDGEIRHYVERPLPHLNDQVVGVIDWERRFDHMQQHTGQHILSAAFAQLYDLHTVGFHLGNDTVTIDLDVSELTEEMAGKAEKLANEIITENRSIVAKWVEYDDLVNYPIRKLPSVKENIRLVMIDEFDYNGCGGTHPSATGEVGAIKVLNWERQRKKIRLYFVCGNRVITQFDQKQKAIVELTGLLNRPEGELSEAIKRLLENVKKLDKALLESYEKNLQYEANELLAKSAIQNDTVMVIETFSDRSIQELQKLAKMIADREKRALIFFLSENDHRFQLVCGRGEANKMNMRDLMQEALSLIDGKGGGNKMFAQGGGTASFTKEKFMKNVMNIIAIQINSEEN

SEQ ID NO: 6861 - protein, 368 aa, Bacillus licheniformis
MNDLQLDTPALLIDKDVMLSNMKDMQNYANEQKVSLRPHTKTHKMPKLAKLQEEMGAVGIAVAKVGEAEVMARNGLKDIFIANEIVGKSKLERIRKLSETIDISFGIDSAYQVREIEEVFEGASKKAQVLVEIEVGEQRSGIIEEDDFRTLLELIKTCQNVELKGIFSHDGHSYKAKSVAHCKELYKESVERTLHFARIAEEMDLKPKVVSIGSTPPFMFKFDIPEGVTEIRPGTYIFMDASQANVIGTYDRCAASVLTTVISKPTKERVITDVGAKGITAQTRSEGLTATKGLGRIKEYEDVYIHGVFDEHAIIYHEEFNKKVSIGDKVRIIPNHICPVCNLHDKAYLVDNGEVVDELNIEARGRLQ

SEQ ID NO: 6862 - protein, 129 aa, Bacillus licheniformis
MKPVHTKYSTRDGGHYVPAMEHNDVLYISGQLSMNPETGKIPAGGIKEEAKQALANMELVLKERGLAKEDVILCRLYTPDVKYWPDINEVYAHFFGNHKPARVVVPSNHLYAGCLVEVEAIAAIKEEAQ

SEQ ID NO: 6863 - protein, 54 aa, Bacillus licheniformis
MENKKIILLSTGGTIASKPDPETGLLEAGAMTGEELSEMCRLPSHIEIEIKSAF

SEQ ID NO: 6864 - protein, 367 aa, Bacillus licheniformis
MEQYQCHSCRTKYNVSEQVWKCQCGGVLDLVKEKVEWSDSKVLKDIPSMWRYIEAMPFDRDSAIWSGITMGEGYTPLIVLDSGEPNTLVKVDYMMPTLSFKDRGAAVLIAKAKELGVKHVIADSSGNAGTSIAAYAKRAEIACDIFLRKGTSPKKIAQAKAHGANVREIEGTREDVAEAAQKAVDIEKKFYASHVFNPYFYEGTKTYAFEIWEQMNGAPDTLIIPVGNGTLLLGVYYGFKELLENKCIDKMPRLVAIQAENCAPLAKAFINNQKAAEPVKSSGTLAEGIAIAKPARSAQILETIRATNGQIITTNEEEILKARTALASKGFYVEPTTAANYAGYLKYSHSSDEKIVIPLCGAGIKSN

SEQ ID NO: 6865 - protein, 124 aa, Bacillus licheniformis
MESIFEAGNLKSNGHYALAVIHQNTVYVSGQFAIDPITQEKKFGTIEEETLQVLSNIEYILKKAGSHKGKILKITLYLHDINLLDRVDNVCQGFFHDYRPARSVVSTTELHYGFQVEIEAIASL

SEQ ID NO: 6866 - protein, 221 aa, Bacillus licheniformis
MTEAKQVLKSYIPFAKTIGEMFGPNCEVVIHDLTTPESSVIFTINNHVTGREVGQSFDHLVKKVLLSNEFKEDYLAGYEIQADDGRTIKSSTTLIRDGQQQVIGAFCINYDMNVMIQMKEMLDAFMPGVEKKNQIQTSNTAEQEASIQNVEEITNQLIEQIVANRKHSMMKRREKIELIRFMDEKGIFLMKGAVDKVAEQLGISKVTVYSYLDEVKKRQSE

SEQ ID NO: 6867 - protein, 126 aa, Bacillus licheniformis
MFGIFLVQSLNLLKPVSGIEISLIDALRIGKRRRHRHHSVQAQSLKKSKNSLTSWTAEKKKFIAGRFSLDLKKEKTQREIAKELGISRSYVSRIEKRALMKVFHEFYREKKELFPNLEYKKTAKLS

SEQ ID NO: 6868 - protein, 189 aa, Bacillus licheniformis
MRAPIDEPIWYAYPGMVAVVTAQYEGEKNAMASGWHTYIGSSPGMYGISLNNETFTYKLIEKSGVFGVNFLPGRCSELIQALGTHSGRDINKFEAFHIQYEEGLKAEVPILTDAYFAYECKVHSISTLGDQEWIAGEVLQRYQDKELFLKKGMPNLEKLDVPLHIGGSSYRILNSQAEEHQHAFNSEAD

SEQ ID NO: 6869 - protein, 281 aa, Bacillus licheniformis
MKEYFSIGETARLNNISIQTLRYYDKIGIFKPQCTDRDNGYRYYHVKQFFYLDIIKYLKSIKTPLEEIKRIISHTSAPELMQTFLEEQENVIEREMEKLERARQLLQRRKDQLHEQLEIRAKKEEGLVYVRHIEGQTILKAATPQVNPHDQSDLYYRKLAEVLEERGDMVDNYYGLIYDLKPYKNSGDIYCNSVYTTIYDGAKIDTEEQNIGMDTIPSGEYVCISFDCSSTNYFSYYQKLYHFIETHGIQTDGKVYQVSFPNSYNSLKEEDFLTEFRVLKK

SEQ ID NO: 6870 - protein, 477 aa, Bacillus licheniformis
MLLRYFYDKKLAHASYLVGCQKTGEAIVIDPGRNLKPYLQAAKEEGLNITAAAETHIHADFVSGARELGATHQAKLYLSDEGDANWKYQYVDESKHQLVKDGDRFSIGNLMFEVMHTPGHTPESISFLLTDGGGNADRPIGIFTGDFVFAGDIGRPDLLEKAAGIKGTSESGARAMFKSLMKFKQLPDYLQVWPAHGAGSACGKALGAIPTTTVGYEKMFNWAMAYTDEEEFVNALLDGQPEPPKYFAEMKRVNKEGPALLKDLSAVLEIMSIEQVKDLQGKEQIVDTRSSREFAEGHLKGTINIPFNKGFTNWAGWLIDYNRPVYLIANPAEVNELLEALRSVGIDNAAGFIDRDKILADGAFSLESYAEITPREIAKLVEDGFVQVLDVRNLTEWQEGHIPNAQHIMLGTLPERLDEIRKDCPILVQCHSGARSAIGASILQANGSFKQVLSLSGGIVQWQKDGLAISTPCSELK

SEQ ID NO: 6871 - protein, 399 aa, Bacillus licheniformis
MARHARYSIVIVGAGTAGISVAARLVRISKKLKGQIAIIDPQTKHYYQPLWTLVGGGAAKKEESERDLASLIPAGVDLIGDAVTEFRPNQNTLLTKQGTIVSYDYLVAAAGLQIDWDGVKGLKDAVGKNGVCSNYSYHTVDSTWENIRNFKGGTAIFTHPDSPVKCGGAPQKIMYLADDYFRKSNVRHQSEIIFASAKSIIFDVTKYANALEKVVLRKDIQTMYKRNLIEIRPDSKEALFEHLETGEQEVFTYDLLHVTPPMKAPSCIKESALADAGGWVDVDPYTLQHKKFANVFGIGDCANLPTSKTGAAVRKQAPVVVRNLMSLIKGSSLDAKYDGYTSCPLVTGYNKLVLAEFDYHKVPQETFPFDQSKERFSMYLLKRRLLPIMYWNGMLKGLM

SEQ ID NO: 6872 - protein, 214 aa, Bacillus licheniformis
MIRVLLVDDHMMIRKGIRVLLEGFSGIEIAGESNNGNEAVLSAGQLKPDVVLMDLSMPNGLDGFTASSEIRKLNPSVKIVILTMHDEEIFVQKAIEAGAHGYVLKNSHYRLLYQAIVEVYRSNLFYKTSVSQDIIDQWLNSEPKKPTSVLTVREKEILRFIVLGYANKEIADKLSISVKTVENHKTNMMQKLDLDSKHELIQYAIKNKYLDLSL

SEQ ID NO: 6873 - protein, 359 aa, Bacillus licheniformis
MCQNPARYTEEGMSNESGYLRQIFDHLQDGIIMMDQERTILVINPSAEKMTGWKLGDKVPYCSYCQTRKLEAGEERCYLLAKREIPYFLSSMPTYEGRFVDMEMSTAVISENGDQMEVLLVLKDLTMKKKEEEAKISKLVLQKTLEAQENEHKRLAQELHDGVGQSLYSVSVGIQAIQSRMEQEETFKDYMQDIIDELEKAIQDVKLYSLQLRPHSLDQLGLIPAVKHLVSSLNKTHQDVSITFASSDISNRLLPIFEINLYRIIQEALHNALKYSQATLIEVILYKEDGELVLIIQDDGIGFERGLTEEGLGFKHMKERVDQMDGSLRIHSALQSGTTIKVKVQDKEGKESDQGIAGR

SEQ ID NO: 6874 - protein, 111 aa, Bacillus licheniformis
MKEAAELTSMVSIEKFITDHQLSFIYISRPQCTVCHAVLPQLRALLARFPKIKLGHINADIVEEVAGRFSVFTVPVLLLFIEGTECLREARFIHFEQLEQKLKRVYQLYEE

SEQ ID NO: 6875 - protein, 260 aa, Bacillus licheniformis
MDISFILLIFFIGFIGSFMSGMLGVGGAIINYPLLLYIPALLGFTGFNAHQVSGIVAVQVFIAAFSGVWAYRKDGYLNKELIFIMGLSILLGSLIGGYGSHFFSEDAINMVYGLLAIIAAIIMLIPKTGTEGNQSDHIRFPKILTSIMTFVVGLASGIVGAGGAFLLVPLMLVIIKIPARITIATSLAVTFISSIGTTATKLVIGQVPIMPALVVMAASLIASPLGVFIGKKVNAKVLQGILIFVIFLTTVKIWVDILLY

SEQ ID NO: 6876 - protein, 75 aa, Bacillus licheniformis
MKSDKVIDAKGFACPMPIVKTKKAMDELQSGEVLEVHATDKGAKSDLTAWAKSGGHELLKDTEEDGILKFWLKKG

SEQ ID NO: 6877 - protein, 376 aa, Bacillus licheniformis
MNFTFVSPKEVAEKLLRKESFFILDVRNKEALSDWKIEGSRVEHLNVPYFDLIDGIEKIDGQVPKDQDVLVVCAKQGSSEMVAQHLVDAGFERVLVLKGGMKAWSKFLHPVKIGDLKEGGTIYQFVRMGKGCLSYFIETDGEAIVVDPARSVDAYIDFAKERNVTIKHVVDTHLHADHISGGRLLRKRTGAAYYLPPKDAEEVLFSYEPLVEDENISVGSAGMKAEPIYSPGHTIGSTSLMIDNRYLLTGDILFVESIGRPDLAGKAGDWAEDLRNTLYVKYKQISGDLIVLPAHFSTVSELGDQGQVQAKLSDLYKKNAGLNLDENEFKGAVSENLPPQPNAYQEIRQTNMGKIMPDADRQSEMEMGPNRCAVHG

SEQ ID NO: 6878 - protein, 190 aa, Bacillus licheniformis
MNIKTDRVLDAKGLACPMPVVKTKKAMNELKPGQVIEVHATDKGSLADIRAWAKGSGHQYLGTTEDGDILKHYLRKAGHSEIKKVKTFPYTIQNEELQKKVEAGERLTVVDVREPAEYRFGHIPGAISIPLGELEKRAHELNRDGKIYVVCRTGNRSDLAAKQLADNGFKDVENVVQGMAEWSGPVEKNQ

SEQ ID NO: 6879 - protein, 160 aa, Bacillus licheniformis
MSDQKEKTTIVLFSGDLDKAIAAFIIANGAAAYDHEVTVFHTFWGLNALRKDEPVPVKKGPLEKAFGFMMPRGSKKLGLSKMNFAGIGPKMIKHVMKKHGVLSLPQLIEMAQEQGVKLVACTMTMDLLGLQKEELIDGLDYAGVAAYLGDANEAKVNLFI

SEQ ID NO: 6880 - protein, 86 aa, Bacillus licheniformis
MEYDDQLKNRIKRVEGQVRGILKMMDEGKECKELVSQMSAVRSALDRAIGVVVSSNLEKCVRLQIERGEDTEDLIQEAVNLLVKSR

SEQ ID NO: 6881 - protein, 198 aa, Bacillus licheniformis
MENNVFEQIAKRYDTEERIELAKVIVNEVRPELRNSQSKSLIDYGSGTGLISLELSDLVHSILLVDSSKQMLEVAKAKISRKGIANAKTLYSDFTQETPELKADIVLMSLVLLHIPDTNKILQELFGILNDGGKLIIIDFDKNDKIQHPKVHNGFSHEELKKRLSDVGFKSTEMKTFFHGRRIFMNQDASMFISSSIK

SEQ ID NO: 6882 - protein, 235 aa, Bacillus licheniformis
MDLETVMKELEALGTENMKKRYITNGAHEPLFGVATGKMKPLAKKIKKNQPLAEQLYATGNYDAMYFAGIIADPMTMTEADFERWIDAAYFYMLSDYVVAVTLAETDFAQAVADKWISSGEELKMSAGWSCYCWLLGNRPDDEFNVAKIASMLDQVERTIHDSPDRTKSAMNHFIYTVGISYLPLHEKAVETAKAVGPVELRRGKKKSSILNASKNIQKDIDRGRLGFKRKYVRC

SEQ ID NO: 6883 - protein, 12 aa, Bacillus licheniformis
HSVPFNKDKKVI

SEQ ID NO: 6884 - protein, 280 aa, Bacillus licheniformis
MIKSFLMLGQSNMAGRGFLNEVDPIYNEKIKMLRNGQWQMMTEPINYDRPVSGVGLAASFADAWSKAHPDEEIGLIPCAEGGSSLNDWHPEGILFQHALAEARFALRSSQICGILWHQGESDSYRSLHETYYEKLTLIIETLRNELKLDEVPLIIGGLGDFLGKTGFGQHATEFRQVNEQLLRFANEQQNCYFVAAAGLTANPDGIHLDAASQRKFGYRYFEAFSKKYHILKPISGEEQSLKVNGDYSKTEQIYLHSMDLASGKITYAEFEARMAMVMKP

SEQ ID NO: 6885 - protein, 81 aa, Bacillus licheniformis
MKRAAIIFIRFYQKAISPLFPPTCRFYPTCSNYGLEAIQRFGFIKGSYLLIKRLLKCHPLHPGGFDPVPNQTDQKKEGDSD

SEQ ID NO: 6886 - protein, 67 aa, Bacillus licheniformis
MRNSLQIPLVSYQVSGEYAQIKAASQNGWIDEKNTVLESMLAMKRAGADLIVTYFAKDIAKFLREES

SEQ ID NO: 6887 - protein, 130 aa, Bacillus licheniformis
MRLMHLGINAFVTGETVTPAFTENDLLIVGTGSGKTESLLHMAEKAKDIGGTVAAVTTSSDSPIAEIADLILQLPGSPKDQTTGSKQTIQPMGSLFEQTLLLIYDAIILRIMEIKGLNTHNMYANHANLE

SEQ ID NO: 6888 - protein, 210 aa, Bacillus licheniformis
MELQLALDLVNIPEAIKVVKEVEEYIDIVEIGTPVVINEGLRAVKEMKDAFPNLKVLADLKIMDAAGYEVMKASEAGADIITILGAAEDMSIKGAVEEAKAQGKKILVDMIGIKDIESRAAELDVLGVDYICVHTGYDLQAIGQNSFADLMTIKNVVKNAKTAIAGGIKLDTLPEVVKLKPDLIIVGGGIANQDDKAAAAAKMKQMIQQS

SEQ ID NO: 6889 - protein, 115 aa, Bacillus licheniformis
MSRMENKTFNCEKELTLNIIGGKWKMLILWFLGKEGTKRFGELKALMPGITQRMLVNQLRELEEDHIVHREVYPVVPPKVEYSLTKQGESLMPILEAMYEWGKNYIETNFSKDDK

SEQ ID NO: 6890 - protein, 352 aa, Bacillus licheniformis
MTEQTIAHKQKQLTKQVAAFAQPDTKNSLLQLLNTFIPFFGLWFLAYFSLNVSYLLTLGITVIAAGFLTRIFIIFHDCCHLSFFKQKRLNHILGFLTGVLTLFPYLQWQHSHSIHHATSSNLDKRGTGDIWLLTVNEYKAAPLRTKIAYRLYRNPFIMFILGPIYVFLITNRFNKKGARRKERVNTYLTNLAIAALAAVCCLIFGWQSFLLVQGPIFLISGSIGVWLFYVQHTFEDSYFEADENWSYVQAAVEGSSFYKLPKLLQWLTGNIGYHHVHHLSPKVPNYKLETAHEQHEPLKNVPTITLKTSLQSLAFRLWDEEKKQFVTFRDMKQTSSHPSPDSTKKQKLRKNA

SEQ ID NO: 6891 - protein, 370 aa, Bacillus licheniformis
MFKKHFTFQKLNGISPYIWTIFFILPFYFIMQSSSTLVIVVGIILTLLFFAVYRFAFVSKGWDVYLWAFILIGISTASIMMFSYIYFAFFIAYFIGNIKKRAPFHILYYVHLISAAVAANFSLVLKKEFFLTQIPFVVITLISAILLPFSIRSRKERERLEEKLEYANERIANLVKLEERQRIARDLHDTLGQKLSLIGLKSDLARKLIYKDPDQAARELKSVQQTARTSLNEVRKIVSSMKGIRLKDEIINIKQILEAAGIAFIYEEDKLPENISLLNENILSMCLKEAVTNVVKHSQAKTCRVDIQQLWKEVVITVTDDGTFQGEEKCFSKGHGLLGMRERLEFANGSLHIDTKNGTKLTMSIPNNSK

SEQ ID NO: 6892 - protein, 199 aa, Bacillus licheniformis
MISIFIAEDQQMLLGALGSLLNLEDDMEVVGKGTTGQDAVDFTKKHRPDICIMDIEMPGKTGLEAAEELKDTGCNIIILTTFARPGYFQRAIKAGVKGYLLKDSPSEELASAIRSVMKGKRIYAPELMEDMYSEANPLTDREKEVLELVADGKNTKEIAQELSIKSGTVRNYISMILEKLEVKNRIEAITRSKEKGWFK

SEQ ID NO: 6893 - protein, 349 aa, Bacillus licheniformis
MSRNELFDVTVIGGGPAGLYSAFYSGLRGMKAKIIEYQPMLGGKVHVYPEKMIWDVGGLTPISGAKLIEQLVQQGLTFHPEVLLNEKVESIARNEEGLFELHTAASGVHLSKTVIVAVGGGILNPQKLQIEGAERFEVSNLNYTVKSLQHFKDKTVIVSGGGNSAVDWANELEPVAKKVYLAYRKDALSGHEAQVDQLLNSSVSCFFHTEITKLIASEDHEVIERVELTNAQTGEVMELPVDEVVINHGYERDTSLLENSRLDVTRVDDYYIAGTSNCQSSVPGLYAAGDIVHYEGKLHLIAGAFQDAANAVNSAKRFIDPEAHKSAMVSSHNEVFKERNRELVKKMFV

SEQ ID NO: 6894 - protein, 540 aa, Bacillus licheniformis
MMSGRISLKIKIIFILMLAFSILLAGCTTSGNSTEKTHENLVTMAWPRDIGEMNPHVYNPSQLFAQSMVYEPLVTYEAGGKLKPHLAESWDISSDGKVYTFHLRKNVTFSDGTKFDAKIVKKNFDSILKHTELHSWLGFISKIAQTEVIDDHTFKLKLTEPYYPTIQELAVVRPVRFLGEAGFPEDGDTSKGVEKPVGTGPWVLEEHKADEYAVFKRNEHYWGEKPKVEKIKVKVIPDAETRVLAFEKGELDLIYGEGVISLDAYKQLQSTGQYETSLSEPVATRQLVMNTKKEQLSDERVRQALQYGFDKEAMVKGITSGLEEKADHILPTDFPYTSDIDVKQINYDTEKAKELLDAAGWKLPNGKTVREKDGKPLEFSLMYDSAESIQKTMAETLQAEWAAIGVKLNLEGVELATQVKRFKANEFDMNFFSNYGAPYDPHTFLNIVASKGFGFNEAISAYPNKDELIKQMAKVPQTTDEKERQEHYSSILKSLQDQGAIVPVSYIKKTAIYQKNITDFTFPANRDEHPFTGIRVKQQH

SEQ ID NO: 6895 - protein, 314 aa, Bacillus licheniformis
MGNYILKRIMSIIPVFLLAALLTTGMIHLSPVDPAEAYLAAAHIQPTDEILAQKRHEFGLDQPFFIQYVNSVLKICQLDFGISYVSNQPVWDEVAHRMPATVELALGSLLIAVLVSVPLGFLAGIKRNGAVDHISRFISFFGASIPTFWLGYMLVFFFSVQLDLFPVEGAGTWQHLVLPSMTLALPLIAMYTRLLRASVIENLQEPYVQFARIRGIAKLNIMAKHVLRMAISPMITGLGMNLGKLLTGTIIVEVVFSWPGFGRYFIEAIFNRDIPVIQCYVFLAATFFILSNLIVDLIQMYIDPRISRKEGQHR

SEQ ID NO: 6896 - protein, 277 aa, Bacillus licheniformis
MMISIRRIFKGQKVITVCTTILTILFIIAVFAPWIAPHHPADVHMVYKLQPPSWEFPLGTDHLGRCNLSRLLYGARISLGFAMLIFISSLVIGLIVGTISGYKGGWIDQLLMRCCDGVMAFPNLILVLGLVGIFGPGLPQVILALMLVQWVYYARIFRGMVLSLKEENFIAAAKINGSSQWKIIKNHIIPNVLPPLVVIGTLEMGWAIMDISAMSFLGLGVQPPAAEWGAMIHEGKSYIRSNPELMIYPGVMIMIVVVTFNLLGEALSDQYGVKRRF

SEQ ID NO: 6897 - protein, 272 aa, Bacillus licheniformis
MGTEQSTVLRVRDLHVQVNNQKGHSTLVQDINFDLKRGQVLGLIGESGCGKTVTSMSILQTLDPKTTKVEGSIALRGRELNGLADKEMRKIRGKDIAYIMQNPMNAFTPVFTIGQQMTESIRSHTSFSKKQAKELATEALHHVNLPHPAKLLHSYPFQLSGGMLQRVMIAIASCLKPAILIADEPTTALDVYNQKTVLKYLDGMRSDFGTAILLISHDLGVIAEMADEVAVMQNGRIVENRDVFQLFDEPKHEYTKKLLSARLTLPVDQLAT

SEQ ID NO: 6898 - protein, 272 aa, Bacillus licheniformis
MSLLQVKEVTHHYTARKLFKWKIQSKQVLSNVSFSIEEGACLGMVGPSGAGKSTLGKVMLGLERPQSGQIFFQGHDLYKADQSIRRKIRRDLQAVFQDSYSSVNPRMTAEQILAEPLENYERLTIAEKKRTIIELLERVGLTEKDLTKYPHQFSGGQLQRINIARAVSLKPKLIVLDESVSSLDMVTQTLILGLLKELKDDFGMSYFFITHDLKAAYQLSDTLGVLDHGQLAGLYDKHRFLKSDHPVVQEMKRSILAEHPRFRSIRTRAVRQ

SEQ ID NO: 6899 - protein, 277 aa, Bacillus licheniformis
MNNRFRVGEVARLFKLPASTLRYYDEIGLFRPKYTDPETSYRYYGVEQFQILDTIIFLRKNGFSLKDIQHQLDQRTPETTMEILKKKLEEVRAEIFRLQRNAARIENKISTIEEGIKLAEHPALTFQYFPKRAISYLYFDKPVDLMEEGDDIYLKDKETLSSQSIENNGFFTGDIGTIVDMESLKQEGPVKYIGVFELLHEEDSEDYLNEGLYASYPHIGPYEDIRKSYQLVLSQLKEKEYELAGIPVEISFLDDAVIKESARYVTLIQIPVTKSFD

SEQ ID NO: 6900 - protein, 450 aa, Bacillus licheniformis
MTETHQQLMKLPVNQVFFKYFVPATLGLILMSANILIDGLFVGNGIGTAALAGVNLSYPVISLIMAIALWIGIGGATKYSISIGENRPKKASSIFSLALFLALIISVLLGVFGILNIQTISIWLGANSDTSSFVIEYLSVMFLFGWVITLEQVLSIFVRNDGSPKLSMMALATTSIVNIILNFYTIMILDMGVTGAAISTVLGGFAGLLVLSLHFFNRQAQLRRPAFQWSWKSLMHIFAIGFPSFLAEAGLLVFVTGYNLAMASLAGTEGVAAFSVINYLHGFMFLSFFGIEMALQPMISYYHGAEETEQIKSSMKIGEKTAVILGILLLVIGWGAAPFLVGLFGIESTEIQQLAIDGIRLFFIGYTFLGYNFVYMSYFQSIGRAGSSVVIIILRSFVSLFILLWILPKFIGVTGVWLSLPLSEFFVAVLLFFIARKHVMGKGNPAIGKG

SEQ ID NO: 6901 - protein, 335 aa, Bacillus licheniformis
MSHTRIKFPAGFWAGLRQLGINAPDVLRKARLPLTVMTEPVVTAAQYFAIWQAYSDLVDDVSKGIIKLATGFEPAHYPPAVLAAYHARDYRGALKRMARYKQLCPPESLRITEEDEHCAIELEWLDDKLPGPPLLIGITLAFLLELGRRGTGQPLTAKSVEFAHPMGDMQALEAYFGCRIRSGAARNRLTLNRGDLDRPFVSYNAELLEILTPVLDQSLNDQQNSLSISGAVKWIMKRTLPGGHPDIQTVASELGMSGRTLQRRLTDEGTSFKQLLIQVRHEQAREYLADPSLDIKEVAILIGYEDQNSFYRAFRLWEGETPSNWRKKTRLNGFN

SEQ ID NO: 6902 - protein, 264 aa, Bacillus licheniformis
MDMGLKNKTALVTGSTKGIGKAIAIELAKEGVHVLINGRNEEEAERTVNEIKSAFPDTFPQNAAADIVDIRQREALFKKHPQIDILVNNMGIYELMQYEDVDDEVWEKYFRTNVLAANGLSKFYLPKMLKSDFGRIIFIASEEAMMPSGQMPQYCMTKSMLLSLSKSLSKLTIGTEVTVNTIMPGPTLSENVKQIIEGMYPDEGMTFSEKEKKFMTTNLPQSEIQRFIKPIEIGRLAAFVCSPYASAFKGSPIRMDGGMVPTIF

SEQ ID NO: 6903 - protein, 596 aa, Bacillus licheniformis
MRMKRLRMRKHLLIAVCTLALLLSSPIVSDASPATKPTTADSPQSSGFFVDHYKNNISANTTAESNPVIGLLSEFNKLWTPGKTWNTGTKLNSRVLDANIQKVVDIAERRTMLEENAAYFDDRRSQSYSIIDGLGKLAGVYRMNAGATTTITSIPADASIRKYNDEGTNSGSTSSELGNVVSLVNTLRGNYSSSNPAKSYFNYPRPFRWKDNSIIVPTLIPVINPDPNKDGGFPSGHTNAAYLSAFAMAYAIPERYQELLTRASELGHNRIVAGMHSPLDVMGGRVMATALSAAILSDPANERLKKTAFDEARRKLLTQTGTAEDRYSDYEKNKKQYTERLTYGFRQMNKTAKPMAVPKGAEVLLETRFPYLDKKQRRSVLATTGLPAGYPVLDDREGWGRLNLFSAADGYGAFTKNVTVTMDSAKGGFHTADRWRNDISGTGKLTKKGTGALKLEGDNTYSGGTRIDQGTLEGGSETAFGRGDVALNGGILKEDAPGKLIIEGDYKQSAKGILELQLSGKKDQLKIKGKARLKGTLRLNFTDNYVPADGSAIITFRKRHGSFSSVETSGLPSKYKVKIIYKSNSIQLKVEQKGRS

SEQ ID NO: 6904 - protein, 275 aa, Bacillus licheniformis
MRGFIKWAGLAILCIGLFACTSNRNAENVHYAKDDRQTLDIYTPQSNEGEKHPVLIYLHGGGWTSGDKSRAASKPAFFTDNGYVFVSVNYRLHPDVQYDEMADDAAKAVKWVMDHADEYQIDPSKINVMGHSAGGHLAGLIAADSTYLNRVGLTPAALNSIVVLDGPLDMKRFIEAIPSYKEVFGTDEKVWTKASPLSYINNSKLPPAYLVTRWEDPAVYKFAETANKAKATEFVYQVNSLSHSDLNKMFGSPDAPAEAQNLTKAVMAFLEKENK

SEQ ID NO: 6905 - protein, 411 aa, Bacillus licheniformis
MSSKQEESFAILTERELSSAAFKDEAYEFYKRLRASRPVCPVSMGELGEGWLITRYDDAVHILKDARVKKNYENAFTEEELENFSALENEEPLSKHMLNADPPDHGRLRSLVQKAFTPRMVLQLENRIQKIADSLLDQVEPNHSMNLVDDFAFPLPIIVISEMLGIPLEDRQKFRVWSQAVIDFSDTPESLEEYKYKIGEFAEYLEYLVRKKRDEPAEDLVSALIQAESEGTKLSIEELYATIMLLIVAGHETTVNLITNMTLALLNHPEQLEKLRQNADLIDSAIEEALRFYSPVELTTLRWAAEPFTLHGQEIKRKDVVIISLASANRDYMVFSNADRFDIERKDNRHLAFGHGSHFCLGAPLARLEAKIAIQTLLRRFEHIEIKGEREQIKWKGNFLMRALEELPLSF

SEQ ID NO: 6906 - protein, 295 aa, Bacillus licheniformis
MKKLIVFVLIGLFAQLIDGALGMAYGVTSSSLLLAFGIAPAVASASVHLAEVVTTAASGVSHIKFGNVDKQTVKRLVIPGSLGAFLGASFLSNIPGELAKPYISMFLLVLGVYVLIRFLFMFKIGEQKNNISLSRKKAVPLGLIAGFADATGGGGWGPIATPVLLSKKGVSARKVVGTVDTSEFAIAVSATLGFFISLGWEEVNWLWVGALMIGGIIAAPIAAWLVQKVHARLMGVLVGGLIILVNTRTLIHSWIDQTALYPVIYIGIIAVWISAIVYIVVKIRTSDQTAQAFNQ

SEQ ID NO: 6907 - protein, 126 aa, Bacillus licheniformis
MKFSKIGALLLTLACLLLPFSSATAAGAGVWDNIGTYGMTSQTPIIKSSGGEFYFHNNSFYGFTFTLYEVDGAGSTPEIARKNFYVGPKSNSPAIDVSSFADGANKQAELVLFKGNDTYITVTCYD

SEQ ID NO: 6908 - protein, 264 aa, Bacillus licheniformis
MNLDLRGKRALVTGSTSGIGKAIAASLAKEGASVIINGRRQEKVNQTIDELKGQFPEAVLQAAPYDLGTEKGCQSLLAAFPDVDILVNNLGIFEPAEYFEIPDEDWFRFFEVNIMSGVRLSRRYLQSMIEKKEGRVIFIASEAAVMPSQEMAHYSATKTMQLSISRSLAELAAGTNVTVNTVMPGSTLTEGVETMLKTLYPDENLTVEEAEKRFMKENRPTSIIQRLIRPEEIAHFVTFLSSPLSSPINGAALRADGGLVRSVF

SEQ ID NO: 6909 - protein, 677 aa, Bacillus licheniformis
MKKRMIQMGIIGAMMFPEAFSAAAADPDYYNEDHRPKYHFTPEANWMNDPNGMVYYAGEYHLFYQYHPYGLRWGPMHWGHAVSKDLVKWEHLPVALYPDEKGTIFSGSAVADRHNTTGFQTGTEKPLVAIYTQDRSGEQVQSIAYSNDKGRTWTKYSGNPVIPNPGKRDFRDPKVIWHEQTKKWVMLLAGGDRILIYTSPDLKRWTYASEFGEGEGSHGGVWECPDLFELPVEGRPNETKWVMQVSVGDGAVSGGSGMQYFVGSFDGTTFKNENPPNRVLWTDYGKDFYAAVSWSDIPKSDGRRLWLGWMSNWQYANDVPTSPWRSAMSIPREVKLKAFSEGLRMIQAPVAELQSIRGASQTWKNKIISPRNGNLLKGLSGDAYEINAEFQVNTGAAAEFGFKVRTGENEYTKIGYSKNSASLFVDRSQSGNVSFNPNFNTGKHAAPLEPVAGKVKMRIYVDRSSVEVFGNDGRQVITDIILPDQSSKGLEVYASNGFVKLNSMTVHPLKKVWGASPFQSNLTGWTTVNGVWADTIDGKQGRSEGDSFILSSAKATDFTYEADVAIKDGNGRGAGALVFRADQDVKNGYLANVDAKHDVVKFFKFEDGSASVIAEHRTPIETGRKYHLKTVARGANFYIYLDDQLVISARDSTFADGAFGLNAWDATAVFQHVYAKR

SEQ ID NO: 6910 - protein, 275 aa, Bacillus licheniformis
MGTEKRLTKREIFSMFIRSNFLLGSFNFERVQALGYCYVMIPAIKKLYGPGAKRSEALQRHLEWFNTHPWLTAPIFGVTAAMEEEMANNKKIDAKAINGMKIGLMGPLAGVGDPIFWGTLRPVLAALGASLALSGNIAGPLLFFFLINAVRLSTKYYGLKYGYVKGMEILQDLVGNRIQKLTEGASILGLFVMGALVSKWTTINIPIVVSRIKDDAGKVDVQTVQNILDSIMPGVLPLGLTLLAAWMLRKGVNPLLMIFGIFIIGIVGYWAGFLA

SEQ ID NO: 6911 - protein, 267 aa, Bacillus licheniformis
MSTIQIILLLVIAAITGIGSVLDEGQTHRPLIACTLVGLVLGDLKTGIILGGTLELMALGWMNVGLAMAPDTAIASVISTILVITADQGIGEGIAVAVALAAAGQALTIFVRTITVFLIHRADKYAKDGNFKGIEIMHITAMAFQALRVMIPTLIVALISVSAVQAFLGNIPEVITKGLQIGGGIIVVVGYAMVINMMNIPYLKPFFYIGFLLAAFTDFNLVGFGALGLCLAFLYQQVMQKNHAQGAVAAASDGSMAAYDDDDDLDA

SEQ ID NO: 6912 - protein, 163 aa, Bacillus licheniformis
MKIVLARIDDRFIHGQVLTRWIKIHAADRIIVVSNEVAQDEMRKTLILSVAPSNVKASAVSISKMAKAFHSPRYEDTTAMLLFENPGDIVSLIEAGVPIEIVNVGGMRFENNRRQITKSVSVTEKDIKSFEQLHELGVKLELRQLPSDSSEDFMQMLRNATKS

SEQ ID NO: 6913 - protein, 145 aa, Bacillus licheniformis
MITVIISGHGNFPIALKESSGMIFGEEESLIAVPFLKGEGIQTLQEKYHQTLKDVPEEHEVLFLVDIFGGTPYNAATPYIAKERRFDMAAGVNLPILLEALSLREHMPLKQLLNQLKKMSRECFQICSEQLEKFSQSNQGREDEL

SEQ ID NO: 6914 - protein, 928 aa, Bacillus licheniformis
MKRIDKIYHQLLDNFREKNINQLLKIQGNSAKEIAGQLQMERSNVSFELNNLVRAKKVIKIKTFPVRYIPVEIVENVLNIKWNSELMEVEELRRLADGQKKPARNISADPLELMIGAKGSLKKAISQAKAAVFYPPHGLHMLLLGPTGSGKSLFANRIYQFAVYSDILKPDSPFITFNCADYYNNPQLLLSQLFGHKKGSFTGAGEDKAGLVEQADGGILFMDEIHRLPPEGQEMLFYFIDSGTYNRLGETEHKRTAKVLFICATTENPSSALLKTFLRRIPMTVHIPSLNERSLGERVELTTFLLGKEAERIKKNLNVHIDVYNALIHSAKFGNVGQLKSNVQLVCAHGFLNNLDKDEVVELTVRDLPDEIKEDWMSSSKNIERSKMISEYVNITTIISPIVEDEATKIDDSFNLYHVIEEKAKILNKEGLTKKQINQYILTDIHLHVRSFFNQKMLQNHSLLKFVEDDVIQMTKELKGVAEHELDCKFDRKFIYFLSMHIAAFLKRGKQIDVLNSQETDEIRETHVKEYEVALIFKDKIQAYFKVTVPEIEVIYLTMLIQSIKSWKENKRTGIVVAAHGNSTASSMVEVATELLGSTPIAAVDMPLTVSPSEIVSCLAEKVKQVDEGEGVLMLVDMGSLAMLESRLEQQTGVKIKTISNVTTSMVLDAVRKVNYLNLNLHAIYDSVTKDFIDLWADKPRVSGKKKAIVSICTTGGGTAKKLEEILTSIVSRTSDEQISILTVPSIKLASRIKEIEKAYEILATVGTKNPKIDAPHVPLEVLIEGEGEKVIQQVIATGDIPMSGGLSGENVVVKELCEDSLKKYLVFLNPYHVIDMLLEWLQTVQDELRMTFSNAVLIKVIMHTAFAFERVIKQNPIAFPEEEEMNDQLENVLHITEKTLKPYEEKLGLAISEDEKMFIASIFAEEL

SEQ ID NO: 6915 - protein, 154 aa, Bacillus licheniformis
MRLFICASCLFGLIVPSFETKALTFEELPVKQASKQWEVQIGKAEAGNGMAKPEKGAFHTYAVEIKNIGHDVASAEIFVYRNEPNSSTKFSLWNIPHENPVSLAKSLNHGSSVKHRNLLMAENATELEVDMIWTEKGSEGRLLKETFIFKGDES

SEQ ID NO: 6916 - protein, 86 aa, Bacillus licheniformis
MPQNNNKRYELFFKKRYKVLHTLNDFLIGLLFLVGSFCFFSEELKPAGLWMFVIGSFQLLIRPTIRLVHDFHYRKFVESRRSKCRE

SEQ ID NO: 6917 - protein, 216 aa, Bacillus licheniformis
MNFQTIELDTWYRKSYFDHYMKEAKCSFSITANVNVTNLLAVLKKKKLKLYPAFIYIVSRVIHSRPEFRTTFDDKGQLGYWEQMHPCYAIFHQDDQTFSALWTEYSDDFSQFYHQYLLDAERFGDKRGLWAKPDIPPNTFSVSSIPWVRFSNFNLNLDNSEHLLPIITNGKYFSEGRETFLPVSLQVHHAVCDGYHAGAFINELERLAADCEEWLV

SEQ ID NO: 6918 - protein, 136 aa, Bacillus licheniformis
MQIFFNAKDALSEGYRPCKRCNPAGALLPDEELAQRVVEIIEESYRDPLSLQALADRCHISPFHLQRTFKRIKGVSPAEYILQKRIEKAVDLLAHSERSIAEIASMVGIANAEYFASLFKKKTGQSPTSYRQMKRR

SEQ ID NO: 6919 - protein, 175 aa, Bacillus licheniformis
MDDQIVYWRTLICRGWQIHIGATARGLCFTGGWNQGFEDLAAWAEKRFTQPVFIRDDKGLAEYAEQLQAYLNGKRTHFSFPVDLAGTPFQLAVWKALSEIPYGSTCSYSDIAEHIEKQAAVRAVGAAIGANPLLMVVPCHRVIGKSGQLTGYRGGLDMKKELMMMESGGVTAQFN

SEQ ID NO: 6920 - protein, 282 aa, Bacillus licheniformis
MMTAKNLQDRIKLNNGTAMPWFGLGVFKVEEGPELVQAVKTAIKHGYRSIDTAAIYGNEEGVGQGIREGLKEAGISREDLFVTSKVWNDDLGYDETIAAYEASLEKLGLDYLDLYLIHWPVEGRYKAAWKALETLYEQGRVKAIGVSNFQIHHLEDLLKDAAVKPAINQVEYHPRLTQKELQAFCRAHGIQLQAWSPLMQGQLLSHPLLKDIADKYGKTPAQVILRWDLQNGVVTIPKSTKAERIAQNADIFDFELTTEEMKQIDALNENTRVGPDPDNFDF

SEQ ID NO: 6921 - protein, 411 aa, Bacillus licheniformis
MTSVHDKKRSILALLALAASAFAIGTTEFISVGLLPLIAEDMNISVTTAGLTVSLYALGVTVGAPVLTSVTSSMPRKALLLVIMLIFMIGNGLAACAGSIGVLLTARVISAFSHGVFMSIGSTIAASLVPADKRAGAISIMFTGLTIAMITGVPIGTFLGQQFGWRIAFAAIVAVGALAFIANSLLVPGDLPKGVRTSFKSQLKLVTNGRLLLLFIITALGYGGTFVVFTYLSPLLQHVTGFKQEAVAVILLAYGIAVALGNIIGGKAANKKPLTALFYMFIAQAAVLLILTAAAPYQAAGFIVIMLMGFLAFMNVPGLQSYVVILAERFVPGAVDVASAVNIAAFNVGIAIGSYTGGAITQSIGLIHTPWVGALMVLGAVVLTGWSRALERNDQKQNDQKQNQALKENCA

SEQ ID NO: 6922 - protein, 125 aa, Bacillus licheniformis
MKPKKYNISVEATLEVIGGKWKCVILCHLTHGKKRTSELKRLMPNITQKMLTQQLRELEEDGVINRIVYQQVPPKVEYELSEYGWTLKDILDSLCSWGEKHITKVYGDKFAVLEDSVLNEQLQET

SEQ ID NO: 6923 - protein, 221 aa, Bacillus licheniformis
MGKWFLSGGGDAHQTEQLDRHFARSICPHKPLLYIPIAMDADRYDDGFDWISRLFHPLGIKNIVMWTDVKGKTVHDLDVFSAVYIGGGNTFRLLKQFIESHFTAVLKRYAESGGAIYGGSAGAVILGKNIMTCSYMDRNACGLRDFNGLKLLGDYSVWCHYKAEHDPLIKRFRNAFGTPVIALPEETGIAASTSDIRVIGTKPARMFKEDGAVFVSDQFVL

SEQ ID NO: 6924 - protein, 275 aa, Bacillus licheniformis
MGKGLNGRRIAIGASRKTDEMSTLIKKQGGVPLIRSLQGTVFLAEKEVGPDLRAFVETGADWVIFTTGIGTETLVSLAEKLGIGERYLQAIRRAKAASRGYKTIAALKKLGITPVAADEDGTTKGLIDSLQSHDFSGKRVMVQLHGENAPSLLQFLEEKGADVVPLLPYRHVAPDRETVALLCSEIINREVDAVCFTTAVQVRSLFHFAKENGYAEKIVQSFQDSVLAAAVGKVTAEALREEGVERLLAPDLERMGAMIVELARFYETEEGIRTQ

SEQ ID NO: 6925 - protein, 314 aa, Bacillus licheniformis
MHSQFETRAEHLTKHARFFEYTTASDPIGSGIISPVPVKEFGPELYETGETRIIPLDISEELKTDYPASSPSLLAHFIKIRSGDTIHTAPRATSELYYIVSGAGKTETGEDTIHWQKGDFLTLPAGSGSRHTAAEDAAIYYITDSPLLNYLGVKPSESRFQPTLYTAEQSKAKLAEAAAAPDARYRNRISVLLNNEIFDQTLTITHVLWAMFGIVPPGSNQAPHSHKSVALDFVAYAAPGTYTLVGSKIDPATKEIIDPKRIDWVTGKAFITPPGLWHSHHNESDEAAYIIPIQDAGLQTYLRTLDIQFQHYEK

SEQ ID NO: 6926 - protein, 318 aa, Bacillus licheniformis
MTKKQYSYIFTLLLAFAVFLSGCQSGQKQAASEKNEEKTRVVKTINGNVTVPANPKRVVTIGYAGTMLAFGIKPLGETGKYLGSPYIKDQVSGIKDIGGKDGFSVSVEKVLELKPDLIVSMTNDSKEYEKLSKIAPTVVYPFGTFKDARDEMKTFGKLLGKEKEAREWTKTFNQKMKAARAKIKDASVKGETFSLIGAYAKSLYVYGAYGYRGGEAIYTQLGLTPPESVKKDAIDTADGYKAISFEVLPKYAGDYIFVDESYNGKLDQDNPVWASLDAVKKGKVFFLDPDRFWPYDPNAVQAQAEEIADMISKKAKNK

SEQ ID NO: 6927 - protein, 299 aa, Bacillus licheniformis
MELYQIDHFIAVSRHKHFTKAALEQRISQPALSRSIKKLEEELGVPLFIRKTKSIRLTKYGEQFLIKAKQARLALDEGVQQIRESVNPNAGEISVSFLHTLGSRLMPQLIAEFKKKYPNVAFRLYQAANEHLQHMVETGEADICLSSPPLPNEHLEWTVLDTEPLYLVLPADHPLADRKEVAIRSIAHEDFVCFKPGYGLRYVFDQMCRGLSISPKLAFEGEEVSTILGLVSAGLGVAILPKTAEHVHSPVAFCRVSDYRSERTIGLAVLKDHYLSPAARNFKEFVIEYYRRNERSDQP

SEQ ID NO: 6928 - protein, 405 aa, Bacillus licheniformis
MTYIQPHSKDYHKASIALFISGFVTFATLYTTQPLMPLFAEEFGISAAAASLTLSISTGILAFALLTAAALSDGFGRKTIMAISLFATSVLGLLTAFSPNFAALLAMRGLLGFFLAGVPAIAMAYVGEEFDPRGLGKMMGLYISGTSLGGMSGRLLTGLLTDLFSWRAALGIIGALSVLLSYLFWILLPRPQHSAKRKTSVKKASLAYGAVLMNKRLLSIISLGFLLMGSFVTLFNYIGFQLMGPPYRLSQTVIGFIFIVYLAGTLSSVYMGKKADRFGSPLMLKIGIAIIAGGALLTLLPQLPLKIAGIAVFTFGFFGSHSIASSWVGQTAGEQRVQASSLYLLSYYLGSSLAGSFGGFFWTHFKWPGIISFIIGLLLIAYPVIFFAEAKRNKRQDNSQVRNKS

SEQ ID NO: 6929 - protein, 127 aa, Bacillus licheniformis
MLKTIGFYGFLASVCLNLFLRFGLKINGTANDIISTASLVFVLVYVWDDLKKRSAKTLILQGITLIIFVALLVFVIMKGQTFIASLPFFEGWETPAKWVYILLVLFLGSNLFIYINEKITNSKKEAS

SEQ ID NO: 6930 - protein, 1074 aa, Bacillus licheniformis
MNKLDGIPIPKTYGPLGNLPLLDKNRVSQSLWKIADEMGPIFQFKFADAIGVFVSSHELVKEVSEESRFDKNMGKGLLKVREFSGDGLFTSWTEEPNWRKAHNILLPSFSQKAMKGYHPMMQDIAVQLIQKWSRLNQDESIDVPDDMTRLTLDTIGLCGFNYRFNSFYREGQHPFIESMVRGLSEAMRQTKRFPLQDKLMIQTKRRFNSDVESMFSLVDRIIADRKQAESESGNDLLSLMLHAKDPETGEKLDDENIRYQIITFLIAGHETTSGLLSFAIYLLLKHPDKLKKAYEEADRVLTDPVPSYKQVQQLKYIRMILNESIRLWPTAPAFSLYAKEETVIGGKYLIPKGQSVTVLIPKLHRDQSVWGEDAEAFRPERFEQMDSIPAHAYKPFGNGQRACIGMQFALHEATLVLGMILQYFDLEDHANYQLKIKESLTLKPDGFTIRVRPRKKEAMTAMPGAQPEENGRQEERPSAPAAENTHGTPLLVLYGSNLGTAEEIAKELAEEAREQGFHSRTAELDQYAGAIPAEGAVIIVTASYNGNPPDCAKEFVNWLEHDQTDDLRGVKYAVFGCGNRSWASTYQRIPRLIDSVLEKKGAQRLHKLGEGDAGDDFEGQFESWKYDLWPLLRTEFSLAEPEPNQTETDRQALSVEFVNAPAASPLAKAYQVFTAKISANRELQCEKSGRSTRHIEISLPEGAAYQEGDHLGVLPQNSEVLIGRVFQRFGLNGNEQILISGRNQASHLPLERPVHVKDLFQHCVELQEPATRAQIRELAAHTVCPPHQRELEDLLKDDVYKDQVLNKRLTMLDLLEQYPACELPFARFLALLPPLKPRYYSISSSPQLNPRQTSITVSVVSGPALSGRGHYKGVASNYLAGLEPGDAISCFIREPQSGFRLPEDPETPVIMVGPGTGIAPYRGFLQARRIQRDAGVKLGEAHLYFGCRRPNEDFLYRDELEQAEKDGIVHLHTAFSRLEGRPKTYVQDLLREDAALLIHLLNEGGRLYVCGDGSRMAPAVEQALCEAYRIVQGASREESQSWLSALLEEGRYAKDVWDGGVSQHNVKADCIART

SEQ ID NO: 6931 - protein, 191 aa, Bacillus licheniformis
MESESKYQKIIEASLVLFADRGFDAATIPMIADKANVGAGTIYRYFDSKEALVNVLFQDSVKRFKEKIEEGYPEDSAGIKKQFQHIFRCLFEFSQENIHALYFLEIDKTSHYLTEKSREVLNELLDFIYLFFEKGKAAGMIRPLPSHILSAVVFGAFVHIQKLVRAGEFEDPTELMEEIEECSWDAVKHHG

SEQ ID NO: 6932 - protein, 1019 aa, Bacillus licheniformis
MAAEDSVPNNETTLTSASPVEASFQSDDEVHWYKVNPSNQEIANYTHFRVKLKSDAELNISVYSSLENATGHQTFDRYNGYSYENNPALIDFPIAWKGPYYIKVENHHDEENETTSITDISYTISYEGVTLPPSIQEAEEECPAELSVSERETGKGILKQLRTIRDEVLSKTEKGKELSSLYYKAAPFISAKMLFNKSMRDSVYKDLVQLKPLFADVAKNGQVSAYSITNDDQKAISRLYETARASVPEPLKKQLDQVAKDIGIEQLTGSKVSAVLEKAGMATASSSAPENRYIVKLKEGKKPGSFKSKAQSSGVQALEPLGKSKTAFKDMYVVEMKESRSSGFKAAAKQYQAAASKIAKMPEVEFVEQVQQYEALSRDTQYPYQWSLKNNGKNRAANADIQFEQLQKLMKGKKLKDTVIAVVDTGVDHTLADLSGSVKKDEGYNYVGRTADAMDDNGHGTHVSGIIAAAQDNHFSMAGINAYAKILPVKVLDSSGSGDTEQIANGIIYAADHGAKVINLSLGGPYSRVMEYALKYAASKNVTIVAATGNDGVSEISYPASSKYTLSVGATNNLDLVSDYSNYGKGLDMVAPGTDIPSLVPDGNVTYMSGTSMAAPHVAAAAGLLLSQNPSLKPKQIASLLTETTADVAFEEQDNPNPDYDLDIEPAAQIPGYDFVSGWGRLNVFHAASVFELNMKVHPVLNRHTAVTGTAKSGVTVKILRGKQVLGTGTAGKSGAFSVKIPAQKAGQVLHVAASGHQAETSLRTVVEKAPKNPSVKRITNKDTAVTGRTAAGYTIKVKNASKKVIAQGKADASGAFKVKINKQKEYAVLYVSASADDHRESGDVKMTVADVIPPGAPKVYQVSDKSTVIQGKTEANAQVSAKAKGKTIASGKANGKGEYKLKISRQKAGTVIGVTAKDKAGNVSKATAVTVLDKTPPSAPKVNPVTNKSTAVKGKAEANAAIIVKSGKKTIGTGKADKKGAFFVKIKKQKANTVLAVTAKDKAGNTSKVSKIKVKKAK

SEQ ID NO: 6933 - protein, 201 aa, Bacillus licheniformis
MFEQWLGKQLRSPRGILSKWVASYMENGNHDINEWTINLMDICPHERILEIGTGSGAALYRIAEMLEGGKACGIDASKSMVKQGMRRIRHVKEEGKAELKLGHAEQIPYPDRSFHKVFSVHTIYFWTDFKQALKEIYRVLQVDGTLFLAVHLEGQMKKSKKTKGFSLYSEEQIKQLLEESHFRDITVHMNKNYCCISAVKS

SEQ ID NO: 6934 - protein, 49 aa, Bacillus licheniformis
MGFGYGGGCCGGWGGYPGGYGGGYGYGGGFALVVVLFILLIIIGACYVC

SEQ ID NO: 6935 - protein, 49 aa, Bacillus licheniformis
MTINLFFLTLTIQRRFKSPEEYEREYEIEQMYNEMKDLQLKYLYLNSQR

SEQ ID NO: 6936 - protein, 77 aa, Bacillus licheniformis
MQKKKVKSLMEDYKQFAFTLLSVSAFLYIGSVIPGQGLETAQKMTMMLATCGFLGGAFYCVKRSLKYKRQLDEMEES

SEQ ID NO: 6937 - protein, 380 aa, Bacillus licheniformis
MKPKTKMIHGGITGDEKTGAVSVPIYQVSTYKQPRAGQHTGYEYSRTGNPTRTALESLIADVEGGAAGYAFGSGMAAITAVMMLFKSGDHIVLTDDVYGGTYRVMTKVLNRIGIEATFSDTSSIEDIEKAIKPNTKAIYVETPTNPLLKITDIKKTAETAKKHDLLLIVDNTFYTPYFQNPISLGADIVLHSATKYLGGHSDVVGGLVVAASKELAEEIHFIQNSTGGILGPQDSWLLMRGMKTLGLRMEAHEQNARKIAAFLDDHPAVKKVYYPGLPSHPGHELAKRQSTGFGGMISFDIGKEENVDLVLGRLKWFTIAESLGAVESLISVPARMTHASIPPERRLELGITDGLIRISAGVEDIDDLLEDLQQALAPLS

SEQ ID NO: 6938 - protein, 307 aa, Bacillus licheniformis
MNVIKDITELIGKTPLLQILDFRIPKGVNIYAKLEMMNPGGSIKDRLGEVLIAEAIGSGKLKPGGTVIEATAGNTGIGLALAARKHGIRPVFCVPEHFSMEKQSIMKALGARIVHTPRSAGMKGAIEKALELEKEIPDSYCVLQFKNPVNPLAYYKTIAPEIWNDLGGRIDVFVAGAGSGGTFAGTAKFLKEKNPSIKTVIVEPEGSILNGGEPHGHKTEGIGMEFIPEYMEESYFDEIYTVLDEDAFRLVKEAAEKEGLLIGSSSGAALFAALKEAEKAKAGTNIVTIFPDSSDRYLSKKIYEGGI

SEQ ID NO: 6939 - protein, 231 aa, Bacillus licheniformis
MKIAVIGAMEEEVTILRSKLEQTNREVIANCEFTSGFYEGKEVVLLKSGIGKVNAAMSTTILLDRFKPDVVINTGSAGGFHHSLNVGDIVISTEVRHHDVDVTAFDYEYGQVPNLPAAYKADNALIQAAEDEASELGHIQVVKGTIATGDSFMSDPDRVAFIRGKFEDLYAVEMEAAAVAQVSYQFNTPFVVIRALSDIAGKESEISFDQFLEQAAKHSTDLVLRMIKRIN

SEQ ID NO: 6940 - protein, 213 aa, Bacillus licheniformis
MGREFIPLFENWANSYDDTVVGRDLQYKEVFRDYDGILDDVVSRSGHKVLEFGVGTGNLTAKLLAAGKAVTGVEPSKAMREIAEAKLPENAVIVDGDFIDFPDPPFSPDTIVSSYAFHHLTNEEKREAVKRYGKMLGKHGKIVFADTVFKNREAFSAAVKKAKENGFLQLAEDLETEHYPTISEMETIFTSEHFSIAFQKHNDFVWVMEAAKL

SEQ ID NO: 6941 - protein, 72 aa, Bacillus licheniformis
MEDWFMNFGLDLIKDKIEFFEALSLEELEKKISQQIENNQAILLRVHSVSHHTAVIDGRIHYSAVVHFKAES

SEQ ID NO: 6942 - protein, 228 aa, Bacillus licheniformis
MSETRESRFENRDKRRKANLVLNILIGIVLVLIVVVASSLMMNSPKEQAQQDVSKNDSEQTTEAPASDNKKQTSDEDVKDEDKGKSDSADKEDSDSDSDKDKESASDEDKSTSDDPFEGAEVTEGGSSANVEKTIINPDWEPVGTQQSGQHTATYDSSSQDWKEMLEAISYATGVSKDNMTVIWLGNNGSPQDAKGTIRAKDTGVKYQVAITWVDGKGWKPTKVEQLK

SEQ ID NO: 6943 - protein, 584 aa, Bacillus licheniformis
MKWQKRMKWVSIIISAALLFLLIRLAEIQLFFTESFSKRNVNLIQESVKQRTEEVRISDGRGSFLDRNGEHLSVSQKPAIVLFPFLKNQPWPAKEAAEILNMTEDELGSKLDHAKKPVILTKHDGASVSKTALEKINKLKYPGVYGVYIEETEKNRLASHTLGMTNQDPDLLRRKYPDKEGLSISTKIGTFGMERTFDEFLLPEQDTKLLYHVDGLGNPLFGMDVKYTADANPFYPLQVKTTLDKKVQQAMEDVLDDHQLDKGWAVLLDIETNGVVAIASKPDLNMAAQKTRQNYMLTPVYPGSVFKTVIAAAAIENGLDHPSKTFNCNLNLYGEAGEDKGKLSLEDSFAESCNYTFTNLAGQLVEKNSSVIEDTAAKLGLTGRVGWEGKLYHEDEFRQFYHETAGSIWGDEKDKKVKKAVAQTAIGQKNVKLTPLEIVNMMATIARGGEKKQVKIADQIEYKNGTLMTAFKDHELPGEKIDQYTAQKLQKLLRKVVTSEKGTGRRFSDLPYDVAGKSGTAQTGRTTDDKKTLYHKWFAGYFPADKPKYALVVVHMDTPDSKAATNAVFYDIVKKVYEIEKNQT

SEQ ID NO: 6944 - protein, 158 aa, Bacillus licheniformis
MAQEKVFPMTETGKKKLEEELEYLKTVKRKEVVERIKVARSFGDLSENSEYDSAKEEQAFVEGRITTLDNMIRNAKIIEDDGANSDIVSLGKTVTFTELPDGEEESYTIVGSAEADPFEGKISNDSPIAKSLLGKQVGDEVTVQTPGGEMLVKIVKIS

SEQ ID NO: 6945 - protein, 211 aa, Bacillus licheniformis
MGKKPVVIGIAGGSGSGKTSVTRSIYEQFKGHSILMLEQDLYYKDQSHLPFEERLNTNYDHPLAFDNDYLIEHLNELLAYRPIKKPIYDYKLHTRSEEVVHVDPKDVIILEGILVLEDERLRDLMDIKLYVDTDADLRIIRRMLRDIKERGRSIDSVIEQYISVVRPMHNQFVEPTKRYADIIIPEGGQNRVAIDLMVTKIQTILEQNAIL

SEQ ID NO: 6946 - protein, 422 aa, Bacillus licheniformis
MSAVKDKISKIVNGKRVITKKPELLAPAGNLEKLKIAVHYGADAVFIGGREYGLRSNADNFSIEEMAEGVEFAKKYGARIYVTTNIFAHEENIDGLEDYLRDLEGAGVSGIIVADPLIIETCRRVAPKLEVHLSTQQSLSNWKAVQFWKEEGLERVVLARETSALEIREMKEKVDIEIETFIHGAMCIAYSGRCVLSNHMTARDSNRGGCCQSCRWDYDLYQTDGTNALPLYEEGDAPFAMSPKDLKLVESIPQMIEMGIDSLKIEGRMKSIHYIATVVSVYRKVIDAYCADPENFVIKEEWLKELDKCANRDTAPAFFEGTPGYEEQMFGVHGKKTTYDFVGLVLDYDEETKMVTLQQRNFFKSGDEVEFFGPEIENFTCKIDTIWDEKGNVLDAARHPLQIVKFRVDNKIYPSNMMRKGQ

SEQ ID NO: 6947 - protein, 309 aa, Bacillus licheniformis
MKKPELLVTPTSVSDIKPLAEAGADAFIIGEQRYGLRLAGEFSREEVKEAIIQAHEKGAKVYVAVNAIFHNDRVPELNDYLSFLDEAGADAVVFGDPAVLMAARESAPNMKLHWNTETTATNHYSCNYWGRKGAKRAVLARELNMDSIVEIKEKAEVEIEIQVHGMTCMFQSKRSLIGNYFEYQGKVMDIEGKKKEKGMYLHDKERGNKYPIFEDENGTHIMSPNDVCIIDELEDLIDAGIDSFKIDGILKSVEYMTEVTAMYREAIDLCIADREAYEDKKEQWIERIEQLQPANRSIDTGFFFKETVY

SEQ ID NO: 6948 - protein, 220 aa, Bacillus licheniformis
MKIGHEELTGYLEKLLKPRPAEIMKLEAYAEEHGVPIMEPTGIEVLLQLLSFKNPKKILEIGTAIGYSAIRMALALPEAEIFTIERDEDRYREALKNIRSFQLENRIHVFFGDALSESDPVQSMAPYDALFIDAAKGQYQKFFSIYEKMLADDGIIFTDNVLFKGLVASEYNQIESKRIKKLVSKIDHYNHWLMEHPDYHTAILPVGDGLAVSQKRGERI

SEQ ID NO: 6949 - protein, 370 aa, Bacillus licheniformis
MFEDQTKKPFIKRLLKHKIKFWLTVVAVLLILTAGAVSLYVKSALEPVDKNNAKTVNVYIPEGSTVTSIAAKLKKEDLIKNEKVFIAYVKFKNASGFQAGNFQLSQSMDAAGMINKLTTASHVPAFKITVPEGRQLQEIADIIAGQTNYSAKDIMKKLDDREFISRLKQKYPKLITDDVLNKNIKHPLEGYLHPATYPFYDPETKLDAIIEAMIKQTDQLAEKYEKQMKDKKMSVHKALTMASLIEEEATEKADRHKISSVFYNRISKNMPLQTDPTVLYALGEHKNRVMYKDLEADSPYNTYKHTGLPPGPIANAGETSWEAALNPEQTDYVYFLAKKNGEVVFTKTLEEHNKAKAKYITNTQDEEKGE

SEQ ID NO: 6950 - protein, 97 aa, Bacillus licheniformis
MITMEHGEKNITIVDDKGNEQLCEVLFTFDSDQFNKSYVLYYPIEAQDDEEIEIHASSFVPNEAGEDGELMPIETEEEWDMIEETLNTFLADEDEEE

SEQ ID NO: 6951 - protein, 139 aa, Bacillus licheniformis
MRILGLDLGSKTLGVALSDEMGWTAQGIETIKIDEAGGDYGLNRLAELTKDYVIDKIVLGFPKNMNGTVGPRGEASQKFAEVLEETFQVPVVLWDERLSTMAAERMLISADVSRQKRKKVIDKMAAVMILQGYLDSLNS

SEQ ID NO: 6952 - protein, 88 aa, Bacillus licheniformis
MSSFDKTMKFNFSDDSMETNVNEVLITVHDALQEKGYNPINQIVGYLLSGDPAYIPRHRDARNLIRKIERDEIIEELVKSYLEQHKEA

SEQ ID NO: 6953 - protein, 878 aa, Bacillus licheniformis
MKTLTSAQVRQMFLDFFKEKGHAVEPSASLIPHEDPSLLWINSGVATLKKYFDGRVVPENPRICNAQKSIRTNDIENVGKTARHHTFFEMLGNFSIGDYFKEEAIEWAWEFLTDQKWIGFDPERLSVTVHPEDDEAYELWSKKIGIPEERIIRLEGNFWDIGEGPSGPNTEIFYDRGEDYGNDPSDPELYPGGENERYLEVWNLVFSEFNHNPDGTYTPLPKKNIDTGMGLERMVSVIQDAKTNYDTDLFMPIIKATEAISGEKYGTSAEKDTAFKVVADHIRTAAFAVGDGALPSNEGRGYVIRRLLRRAVRYAKSININRPFMYELVPVVADIMAAFYGEVKEKADFIAKVIKTEEERFHETLHEGLAILSEVIQKEKAKGNRIISGEDVFKLYDTYGFPVELTEEYAEDEGMEVDHEGFEREMDKQRERARQARQDVGSMQVQGGALRDIMTESEFIGYSDIKTETKIAELLQDGELVDLVQEGQKVQFILEKTPFYAESGGQIGDKGWVKSGDAAIRVTDVKKAPNGQHLHEGIVESGAIKKGMSVTAEVTERLRKDIVKNHTATHLLHQALKDVLGTHVNQAGSLVTDSRLRFDFSHFGQVTKEELEQIETKVNEKIWASIPVQIDLKPIAEAKAMGAMALFGEKYGDIVRVVQVGDYSIELCGGCHVRNTAEIGLFKIVSESGIGAGTRRIEAVTGQGAYEEMNAKLELLEQAAEVLKTNVKEVPKRIEALQSDLKDAQRENESLLAKLGNKEAGEILEKVKEIDGIKLLAEKVNAKDMNHLRTMVDDLKAKLGSAVIVLGAVQNEKVNISAGVTKDLIERGFHAGKLVKQVAEACGGGGGGRPDMAQAGGKQPERLAEALASAEEWVKSVL

SEQ ID NO: 6954 - protein, 352 aa, Bacillus licheniformis
MLKKPLQLLMWVSIFMLLLLTVYIFLQLRMIWEPVCVLLKSILIPLAIAVFITYLLLPVVEKIHRAGVPRTLSILLIYFLFFAGLGYAFYKGVPILIKQLTELSEGIPVLAASYENMLDQLHHHTDGWPDGMHDRVDRFVNQTEEFVASWVERTIRSIRFVFDYMLLAAIIPFLVFYMVKDIDTMKKAVWYLTPSSWRARGSEFIRDVDDSLGDYIRGQLFVCLVIGLGASLSFWFFDLPYPLILGLVIGATNVIPYFGPVIGAIPAVMVAAALSTRLVFVVIITILILQFIEGNILGPLVVGKSLHMHPVVIMLGLLAGGELAGIIGMILAVPVMAVIKVMLVHFLAARKA

SEQ ID NO: 6955 - protein, 43 aa, Bacillus licheniformis
MNRTMTSLISLGAGALMYYMASQNDMMNKRNMRKLRRRVMKMF

SEQ ID NO: 6956 - protein, 63 aa, Bacillus licheniformis
MLVCPNCKSKNIGKIGVNQYYCWGCFIELTLSKGKISTHQVEEDGTLSSLDDLFTDDERTINL

SEQ ID NO: 6957 - protein, 154 aa, Bacillus licheniformis
MRTCNELEGLNVYDRQSSLPLGVVTDICFSHEGTCLGLIMEEKRRFYNPRSLLPLPAVTEIGRDGVYVDFTEFKPMQVPKQSLSYDQMKQKMVKNGAGDTLGMLEDVYFSSDTGIIVAYELSDGFFADLSGDKKQIHSSGEPLEVGRSTIVLNE

SEQ ID NO: 6958 - protein, 799 aa, Bacillus licheniformis
MMQRHNPDQIEMEEASFVKGTVTAVIYHNETNLYTVLKVKVEETSESFEDKTVSVTGYFPLIHEDDIYTFYGKTASHPKFGLQFQADHFKKEVPTTKEGVIQYLASDLFEGIGKKTAEEIVNKLGEGAINKILSDGAVLYDVPKLSKKKADKLAAALQQHQGLEQIMISLSEFGFGPQLSMKIYQAYEAETLDKIRENPYQLVKDVEGIGFIKADELGGRMGISGKHEERIKAAILYTVEATCLQEGHTYIETRQLIIETQKLLNQSAGDEKVTEMDVADAIISLGEQKELFIEDERCYYPSLYYAEQSFAKRVQKIAGQTEYDDQFPESEFLLALGELEERMKVQYAPSQKEAIQKALMSPMLLLTGGPGTGKTTVIRGIVELYSELHGLSLNPADYKKDETFPFVLAAPTGRAAKRMSESTGLPAVTIHRLLGWNGAEGFTHDEDNPIEGRLLIIDETSMLDIWLANQLFKAIPDRIQVIMVGDEDQLPSVGPGQVLRDLLASNVIPSVRLTDIYRQAEGSSIVELAHEMKQGKLPENLAAPTKDRSFIRCRQQQIKEVVEKVVKNALQKGYSARDIQVLAPMYRGAAGINELNALLQGILNPPKPKGREMKYGDVVYRTGDKVLQLVNQPEHNVFNGDMGEIVSIFYAKENTEKEDMAVVSFDGNEITFAKKDFNQFTHAYCCSIHKSQGSEFPIVILPVVKSYYRMLRRNLLYTAITRSKKFLILCGEEEALEWGVKNKESSERQTSLKRRLQQAAHEEDEELMALQKELPFSVYDANIGMEGITPFDFMEKEAE

SEQ ID NO: 6959 - protein, 216 aa, Bacillus licheniformis
MDYNQIGIDAMQKGDFEKAAEAFTKAIDENSGDPVPYINFANLLSAVGELDRALKFYDRAAALDEKAGAAYYGAGNVYVMKERYQEAKDMFEKAHRTGMENSDLYYMLGTTLVKLEQPKLAMPYLQRAAELNDADVEARFHYAMCLANEGMLDEAITEFSNVTERDPSHADAFYNLGVAYAFKEDRKTALDMLNKALDIQPDHMLSIRAKQLLEEA

SEQ ID NO: 6960 - protein, 372 aa, Bacillus licheniformis
MAKRPEDTRVVVGMSGGVDSSVAALLLKEQGYDVIGIFMKNWDDTDENGFCTATEDYEDVIKVCNQIGIPYYAVNFEKQYWEKVFQYFLDEYKAGRTPNPDVMCNKEIKFKAFLEHALSLGADYLATGHYARVDRTDGRVKMLRGLDENKDQTYFLNQLTEEQLSKVLFPIGQLQKSRVREIAKEAGLATAAKKDSTGICFIGERNFKTFLSQYLPAQPGDMRTMEGEFKGRHDGLMYYTIGQRHGLGIGGSGEPWFVVGKDLEKNILYVDQGFDNPLLFSDKITATNVSFVHKGVFGGEEELACTAKFRYRQADHEVTVRMTGTDEAEVVFKEPVRAVTPGQAVVFYKGEECLGGGTIDDVFKDGQQLWYV

SEQ ID NO: 6961 - protein, 379 aa, Bacillus licheniformis
MERIYLDHAATSPTDPRVVEKMLPYLTENFGNPSSIHSFGRESRKWLDSTRELIAQEIGAHPNEIVFTSGGTEADNMAILGSALAREKQGRHIITTKIEHHAVLHTCNRLEEMGFDVTYLDVDESGRISAEQVKDALRDDTILVTVMYGNNEVGTIQPIDEIGDLLKDHPALFHTDAVQAFGFLPIDVQKSRIDMMSVSGHKLNGPKGTGFLYVNENVKLSQLLFGGEQERKRRAGTENVPGIAGLGEAVLLSGREREEKSDLYRRFKDIITRTLEAEGVSFDVNGSRRHSLPHILNLYFPGVSVESLLVNLDMAGIAVSSGSACTAGSVLPSHVLSAMFGEEDDRLTSSVRISFGFGNTEEQVERAAKELAKVVKRLS

SEQ ID NO: 6962 - protein, 138 aa, Bacillus licheniformis
MKISTKGRYGLTIMIELAKKHGEGPTSLKSIAQTNDLSEHYLEQLVSPLRNAGLVKSIRGAYGGYILGEEPAAITAGDIIRVLEGPISPVEVLENEEPAKRELWIKIRDAVKEVLDSTTLEDLASYTEGEQEAYMFYI

SEQ ID NO: 6963 - protein, 421 aa, Bacillus licheniformis
MKPLAFRMRPTKIEEVLGQDHLVGEGKIIHRMVQAKHLSSMILYGPPGIGKTSIATAIAGSTSIAFRKLNAVINNKKDMEAIAAEAKMSGQVILILDEVHRLDKGKQDFLLPYLENGMIIMIGATTANPYHAINPAIRSRTQIFELHPLDPEQIKTAIKRALEDKHRGLGSYDVAVDDEALDHLARGCGGDVRSALNALELAVLSTKENSEGAIRITLEIAEECLQKKSFVHDKDGDAHYDVISAFQKSIRGSDVNAALHYMARLIEAGDLESLARRLLVIAYEDVGLASPQAGGRTLQAIQTAERIGFPEARIPLANAVIELCLSPKSNSAILAVDEALSDVRSGKIGDVPNHLKDAHYKGAAELGRGVEYKYPHDYENGWVKQQYLPDPLKNKVYYQPKQTGKFELALKQVYDKLMKQK

SEQ ID NO: 6964 - protein, 254 aa, Bacillus licheniformis
MLHQFSRNELAIGKEGLNILKNSTVAVLGVGGVGSFAAEALARSGVGRIVMVDKDDVDITNVNRQLPALLSTVGQPKVDLMKARIADINPECDVIALKMFYTEETYEQFFAYEPDYVIDASDTIHYKIHLMKECLKRGINIISSMGAANKTDPTRFQVADISKTHTDPIAKVIRTRLRKEGITKGIKVVFSDESPIVIREDVRQVVGNDEAKIRKAQMPPSSNAFVPSVAGLIMGGHVIMELLKDIPIKRVKDK

SEQ ID NO: 6965 - protein, 592 aa, Bacillus licheniformis
MFGRTYYCGEITEKAIGETVVLKGWVQKRRDLGGLIFIDLRDRTGIVQVVFNPDVSKDALETAESIRSEYVLDITGKVVAREEATVNPNLKTGRIEIQAESVDVLSAAKTPPFAISDQAAEVSEDIRLKHRYLDLRRPEMFNSLKMRHNVTKAVRRFLDDNGFLDIETPVLTKSTPEGARDYLVPSRVHEGEFYALPQSPQIFKQLLMVSGFDRYYQIARCFRDEDLRADRQPEFTQIDIEMSFMSQEDIMKLSEEMMAHVMRETHGIEISLPLPRMSYEDAMNRYGSDKPDTRFGMLLTDVSEAVKDSDFKVFASAVANGGAVKAINVKGAAANYSRKDIDALGEFAANYGAKGLAWLKTEADGLKGPIAKFFAGEKQEALVQALDAADGDLLLFVADKLEVANDALGALRLKLGKELNLIDESLFNFLWVVDWPLLEYDAEEGRYYAAHHPFTMPVREDLKLIETNPQDMKAQAYDLVLNGYELGGGSIRIFEKDVQEKMFGLLGFSEEEAKEQFGFLLEAFDYGAPPHGGIALGLDRLVMLLSGRTNLRDTIAFPKTASASCLMTEAPSEVDNAQLDELHLEIKRKIRQ

SEQ ID NO: 6966 - protein, 424 aa, Bacillus licheniformis
MGFNIPRGTQDILPGESERWQYVEKIARETCHAYQYKEIRTPIFEHTELFSRGVGESTDIVQKEMYTFADKKGRSLTLRPEGTASAVRSFVENKLFANPVQPTKLYYIGPMFRYERPQTGRYRQFYQFGIEAIGSNDPAIDAEVIALAMSVYRKAGLSNLKLVINSLGDKESRTAHREALIRHFEPRIDEFCSDCQKRLRQNPLRILDCKKDRDHELLKTAPSILDYLNEESKAYFAKVQQYLTDIGIAFEVDPNLVRGLDYYNHTAFEIMSNAEGFGAITTLAGGGRYDGLTEEFGGPKAPGIGFAMSIERLLAALDAENVKVGADEGIDCYIVTLGDKAKDYSVSLLYKLREAGISAEIDYEQKKMKGQFKSADRLNAKYIAVLGEDELNQNQINVKDGKTGDQQAIGLDDFIRFLKTNTES

SEQ ID NO: 6967 - protein, 72 aa, Bacillus licheniformis
MKMICLYYRKKISKGCCCMRYNQRMGRAIHEQDANLHLKEHADPERAGFMEETATELGLTSKESIQNKKNRK

SEQ ID NO: 6968 - protein, 523 aa, Bacillus licheniformis
MKKRAVLILSMMLAAQAAFYTSSNTASAAIGEAVIATDEINVRSGPGLSHEIVSVVSRNESYPILEERGDWVQIQLNGGQKGWVVSWLIKKKSQVSSGSDSASGKVTSSEANLRIRKGPGTSYEVQGVFPEGEQADLLKTDGKWIKISYQNITGWVYSDYVNQGSGAKQSQSSSSHASSSKSGTVGVSTLNVRSTASHQGRIIATLQRNASVTILNEQHGWYEIEFNGQKGWAASHYILEGNTQNSGTSETSSSSEAKRQATIVYEGTNVRSGPSTSSAIVKRTGKGESYPIVSTKGDWYEIKLSNGDSAYVASWVVQTVDQAGSAGDSKSAAPPLAKRSSSGGTIKNKTVVIDAGHGGHDSGTIGTRGTLEKRLTIKTATLLAAKLRADGVNVYMTRNDDSFVSLQSRVATSHYRNADAFISIHYDSFPNASVRGNTAYYYSPSKDRKLAADVQSEIERHSPLPSRGVLFGDYFVLRENKQPAALFELGYLSHPQEEAVVSTNAYRERVTDGIRSGLENYFD

SEQ ID NO: 6969 - protein, 147 aa, Bacillus licheniformis
MRLVVQRVTDASVSVGGETVGEIGLGLMVLVGVTHEDTSEDAAYLAEKLVNLRIFEDEGEKMNLSLLDVGGSVLSVSQFTLYGDTKKGRRPNFTKAAKPDQALQLYEEWNSMLRAKGVTVETGRFGEMMDVKLTNSGPVTFIMDSKA

SEQ ID NO: 6970 - protein, 733 aa, Bacillus licheniformis
MANEQVLTAEQVIEKAKSYLSDEHVAFIKKAYQYAEDAHREQYRKSGEPYIIHPIQVAGILVDLEMDPATIAGGFLHDVVEDTSVTLEDLKEAFNEEVAMLVDGVTKLGKIKYKSQEEQQAENHRKMFVAMAQDIRVILIKLADRLHNMRTLKHLPQEKQRRISNETLEIFAPLAHRLGISKIKWELEDTALRYLNPQQYYRIVNLMKKKRAERELYVEEVVNEVKSRVEEVNIKADFSGRPKHIYSIYRKMAMQNKQFNEIYDLLAVRILVNSIKDCYAVLGIIHTCWKPMPGRFKDYIAMPKPNMYQSLHTTVIGPKGDPLEVQIRTFEMHEIAEYGIAAHWAYKEGKNANEDSSFDKKLSWFREILEFQNESSDAEEFMESLKIDLFSDMVFVFTPKGDVIELPSGSVPIDFSYRIHSEIGNKTIGAKVNGKMVTLDYKLRTGDIVEILTSKHSYGPSQDWINLAQTSQAKHKIRQFFKKQRREENVEKGRELVEKEIKNLDFEVKDVLTAENLQKVADKFNFANEEDMYAAVGYNGITAAQVANRLTEKERKIRDQEEQVKSVQDVTPEVKPYQGKKREAGVRVKGVDNLLIRLSKCCNPVPGDPIVGFITKGRGVSVHREDCPNVLTNEALDRLIQVEWEHEPQTQRRKEYNVEIEILGYDRRGLLNEVLQAVNETKTNISSVSGKSDRNKVATIHMAIFIQNINHLHKVVERIKQIKDIYSVRRVMN

SEQ ID NO: 6971 - protein, 170 aa, Bacillus licheniformis
MDLKKYVTIVPDYPKEGVQFKDITTLMDKGDVYRYATDQIVTYAKEKEIDLVVGPEARGFIIGCPVAYALGVGFAPVRKEGKLPREVIKVDYGLEYGKDVLTIHKDAIKPGQRVLITDDLLATGGTIEATIKLVEELGGVVAGIAFLIELTYLEGRNKLDGYDILTLMQY

SEQ ID NO: 6972 - protein, 782 aa, Bacillus licheniformis
MLASKMRWDVQTPDKEKVEQLAGRLGITPLAASLLVMRGYDTADKASSFLYGNDARFHDPYLLKDMEKAVRRIKQAISDQEKIMIYGDYDADGVTSTTVLLQMLKKCSAQADFYIPDRFKEGYGPNEAAFRGIKESGYSLIITVDTGIAGVHEAEVAKELGIDLIITDHHEPGPVLPDAYAIIHPKQPGCGYPFKELAGVGVAFKLAHALNGELPEDLLDLCAIGTIADLVPLHDENRQIAKRGMEQFRKTKRPGLKALAKIAGAEIHNADEETIGFQIAPRLNAVGRIEQADPAVYLLNTEDEREAEELAEDINALNKERQKIVNQMTEEAVQMIEEEGLDQPVIVVARPGWNPGVVGIVASKLVERFYRPAIVLGVDEEKGIAKGSARSIKGFDLFQNLSECRDILPHFGGHPMAAGMTLNLEDVSALRERINRQAEAVLTEADFIPVQDVDLCCRLEDISVDSIAEMNLLAPFGTGNPKPFVLVSDVKIDDARKIGANKNHLKLVLADDGNKLDCIGFYKGDIEEGIVPGAKISIVGELSINEWNNRKKPQLMIKDAAVNEWQLFDLRGKRSWEEKILKLDPAKRACICFREETKAKLAGTGLEEELTVISGPEDAERLDLESRYAVFIDIPQSLDIFDHVINGKKLERIYLIFYQSDEHFFSTFPTREYFKWYYAFLLKRGSFDLPKYGGELARHKGWTKDTIDFMTKVFFELGFVTIENGVLSVVYHAEKRDLTDSETYREKQRLIELEQKLIYSSADELKQWLDKRMAEKAGAYKV

SEQ ID NO: 6973 - protein, 97 aa, Bacillus licheniformis
MNKQWTLIAALIFTLIVAVFAVINVEPVKVDFLFGTAEWPLILVILVSVLMGALIIGSAGAFQIMRLKKELKALKKEERAKHPELEAEPAAPENQKD

SEQ ID NO: 6974 - protein, 741 aa, Bacillus licheniformis
MKKGRLIAFFLTVLLIGTGLGMFTKPAADNISLGLDLQGGFEVLYEVQPAKQGDKIDRDALISTVEALNRRANVLGVSEPNIQIEGNNRIRVQLAGVDNQNRAREILSTQAQLTFRDTNDKELLNGADLVENGAKQSFKQDTNEPIVTIKLKDADKFGEVTKKVLDMKPNNQLVIWLDYKKGDSFKKESQKADHKYISAPNVSQVLNTSDVMIEGNFTIQEAKDMASILNAGALPVKLVEKYSTSVGAQFGEQALNDTVFAGIIGIAIIFLFMLLYYRLPGFIAVITLSVYIYITLQIFDWMNAVLTLPGIAALILGVGMAVDANIITYERIKEELKLGKSVRSAFKAGNRRSFATIFDANITTMLAGIVLFIFGTSSVKGFATMLILSILTSFITAVFLSRFLLGLLVESRWLDRKKGWFGVRKKDILDIRKTDENTEPPNPFSKWDFVGKRKWFFAFSGVLLAAGLIVLLVFKLNLGIDFSSGSRIEVQSDHKLTTQQLEKDFEQVGLDPDSIVLSGEKNDHGVARFVGVPNQKKIAEVKDYFKDKYGSEPNVSTVSPTVGKELARNALYAVIIASIGIILYVSIRFEYKMAIAAITSLLYDAFFIIAVFSLTRLEVDVTFIAAVLTIIGYSINDTIVTFDRIREHMKKRKPKTFSDLSHIVNLSLQQTFTRSINTVLTVVIVVIALLIFGAASISNFSVALLVGLLSGVYSSLYIAAQLWLVWKGRELKKPKRKPAEE

SEQ ID NO: 6975 - protein, 98 aa, Bacillus licheniformis
MGKHPADLYKDHLKPFLRSKTEEFRILGYDDIEIEELWSYLLNKKWKNRKDVQIHQLAGDILSVKIGEFMNYATVESFKTSNLLDSKEGQDMLDELLR

SEQ ID NO: 6976 - protein, 517 aa, Bacillus licheniformis
MTKQTFLKGTLILIAAGLITRMLGFINRIVIARFIGGEGVGLYMMAAPTFFLAVTLTQFGLPVAISKLVAEAEARRDHRKTKQILVMSLAITGTLSAIITPVFLIYAPLMADTLLTDKRTLYPLLAVTPVVPIIAVSSVLRGYFQGKQNMRPLAVSQVLEQIVRISLVAVCTTAFLPLGIEYAAAGAMLSSVFGELASLLYLFVAFKYKKKIRIRKRFFQSLKAGRTTFFELMSVSLPTTGSRFIGNLSWFFEPIVVAQSLAIAGVAASAATSQYGELTGFALTLLTLPSFITYSLSTALVPAISEGIEQKKMQVVEYRLEQAMRLCLLSGGISAVILFSYADELVSVMYGSSNAAIYVKIMAPFFLFYYFQGPLQAVLQALNLAGAAMMNSLVGAVVKTGLIFVLASRPSLGIMGAALAILTGIILVTLLHAATVSKVLPISINLKEYIVSFGVILISGWGSLLMKEHLFLAQSEPMRLLLCIAVTSCLYVFLLIAFKLVKKEEIQRFPLFGRWIS

SEQ ID NO: 6977 - protein, 216 aa, Bacillus licheniformis
MDEILALTFRTIVLYFIIFILFRLMGKREIGELSILDLVVFIMMAEIAVLAIENLDDHLLHTIIPILVLTLIQVIFAYLSLKNQKIRRLLDGKPTIIIDRGKIDEHAMRTQRYNYDDLMTQLRDKNVERIGDVSYAILEPTGKLSVFTKDGPNKMIELPLIVDGVVQKEELEKIGKDQEWLEQKLEKRGHRDLSKISYCTYNKGSFFIDIKDEFKP

SEQ ID NO: 6978 - protein, 127 aa, Bacillus licheniformis
MNEPKQVGKGILYSLVVIFALMFAGSLLISLLLTFTSLTESSFSWLITAISFITLFIGGFIAGGKSKEKGWLSGGLTALCFSLTVLLFQYLGFGEAFNLKQLLYHSGFLGVSMLGGVFGVNLQGSRA

SEQ ID NO: 6979 - protein, 86 aa, Bacillus licheniformis
MEMLGTLLPIILMFAVLYFLLIRPQQKQQKAVRQMQEELKKGDKVVTIGGLHGIVDSIDESKVVIKTGDNTRLTFDRRAIREASAE

SEQ ID NO: 6980 - protein, 381 aa, Bacillus licheniformis
MSQQPIRYEFIKACKQTGARLGRVHTPHGSFETPVFMPVGTLATVKTMSPEELKEMGADIILSNTYHLWLRPGHDIVKEAGGLHQFMNWNRAILTDSGGFQVFSLSEFRKIEEEGVHFRNHLNGDKLFLSPEKAMEIQNALGSDIMMAFDECPPYPAEYDYMKKSVERTSRWAERCLKAHNRPDEQGLFGIVQGGEYENLRKQSAKDLISLDFPGYAIGGLSVGEPKDVMNRVLEFTTPLLPADKPRYLMGVGSPDSLIDGAIRGVDMFDCVLPTRIARNGTLMTSEGRLVVKNAKYERDFRPIDEQCDCYTCRNYSRAYIRHLIRCNETFGIRLTSYHNLYFLLKLMGQVRDAIREDRLGDFREEFFERYGFNKPNAKSF

SEQ ID NO: 6981 - protein, 342 aa, Bacillus licheniformis
MKVELFDFDLPERLIAQVPLKERDASRLMVLDKKTGEITHSTFKHVIDFLNAGDCIVLNDTRVLPARLYGVKEETGAKVEVLLLKQEEGDVWETLVKPAKRVKRGTVLSFGDGRLTAVCTEELEHGGRKIEFRYEGIFYEVLESLGEMPLPPYIKEQLDDRERYQTVYSKKQGSAAAPTAGLHFTEEILDALREKGVHIAFITLHVGLGTFRPVSAENVEEHDMHAEFYEMSEETAALLNRVRQEGGRIISVGTTSTRTLETIASEHDGRFREASGWTSIFIYPGYTFRAIDGMITNFHLPKSSLIMLVSALAGREHVLSAYRTAVEHEYRFFSFGDAMLIK

SEQ ID NO: 6982 - protein, 66 aa, Bacillus licheniformis
MTEFPKILMVLGAVIFGIGLFMQVIGRLPGDIFVKKGNVTFFFPVVTCIVISIILSVVFSFFGRMK

SEQ ID NO: 6983 - protein, 334 aa, Bacillus licheniformis
MDERLVSSELDNHESAIEQSLRPQRLAQYIGQEKVKDNLKVFIEAAKMREETLDHVLLYGPPGLGKTTLAAIIANEMGVNLRTTSGPAIERPGDLAAILTALEPGDVLFIDEIHRLHRSIEEVLYPAMEDFCLDIVIGKGPSARSVRLDLPPFTLVGATTRVGLLTAPLRDRFGVLSRLEYYTRDELSEIVIRTAELFEVDIDSLSALEIARRSRGTPRIANRLLRRVRDFAQVLGNSSITEEVAVDALERLQVDKLGLDHIDRKLLMGMIEKFGGGPVGIDTISATIGEESHTIEDVYEPYLLQIGFIQRTPRGRIVTPDVYSHFKMEVPNHD

SEQ ID NO: 6984 - protein, 201 aa, Bacillus licheniformis
MIEFVKGTIDYVSPQYIVIENGGIGYQIFTPNPFIYKKNSKETIYTYHYVREDTNALYGFSTREEKMLFTKMLNVTGIGPKGALAILASGDPGAVIEAIENEDEAFLVKFPGVGKKTARQIILDLKGKLADAVPEIAADLFNHEEREQIHEAATALEEALEALRALGYSDREIKKVQPHLKKEEALSTDQYVKKALQKLLK

SEQ ID NO: 6985 - protein, 173 aa, Bacillus licheniformis
MYSRSKFKIGLLLIGSLLAALSFHLEALAEKPAKVQIQLEKVYLDGDVGIENKVEAARTLEDFKAAYKGWQLIDQKKGFILFRKQVDDISPLSKTNGYIGVTEDGVISTFHGRPGILSEPIQSFFQIDIKRLESRMADDLRKGIPYRTKKEFEHVIEAVKSSGSQHHVEDMKT

SEQ ID NO: 6986 - protein, 216 aa, Bacillus licheniformis
MKKAHTYAEAVKYDTKKKFNKLIQKPDDLELIGKGRSAYVFKLTEEGGREMALKVFFPEFKNIAAREAEIYKKLSDSNYYPDIYETGPSYILMEYIKGYTFYECLNKGIRIDDDMICEVDRALNDARRKGLNPSDIHLRNLILTPSGTIKVIDVARFLQTKECRQWDDLKTAYQTLYKKSRFPQRLPKMWMELIAYLYKKSWLQKQWASRKNKFHP

SEQ ID NO: 6987 - protein, 57 aa, Bacillus licheniformis
MLVYEITPLPSRKEKHSLKKKNKRNDDKWDYLYLVDLLEPLFYVLRLAVRGLAKIIN

SEQ ID NO: 6988 - protein, 59 aa, Bacillus licheniformis
MNTQRAQEIVESPDMVDVTYNGRPIYIQRVDEQNETARIFPLGQPENEQEVPLANLKEH

SEQ ID NO: 6989 - protein, 154 aa, Bacillus licheniformis
MERKDRIVQEFMSHRLVTEELIQKIDEKHLDYKPTETSMPAKELVTHMLQSFYTFASAAKEGNGEPFKKKPEETGTSLSELAKTYTEKTKTLLESFTDEELDREVDLTGVFGRKVAGEQLLQLAIGHEIHHKGNLFVYVREMGHTDLPLYVKIH

SEQ ID NO: 6990 - protein, 236 aa, Bacillus licheniformis
MKKKVLIYLVIAAVMINGVYRWSEKTTRESYQIQAGDKYKNFKELQENEKSGYDIDYHEKAGSDCLIFSPHGGRIEGGVSELVRAFNDDYSTYLFEGKKDENNSDLHITSTNFDEPLALQKIKEHRYTIAFHGYSGDRPHTLVGGTDRKLAKAIVKSLKKSDFSAELVKVDGKFAGTAEENINNESQTGMSVQLEISTAQRKEFFEDFSYKEREETKTRTFRKYVKAVRKVLQDRC

SEQ ID NO: 6991 - protein, 59 aa, Bacillus licheniformis
METEYETKGYDLTKVYDYNQYPDVRHGRCDNCDYTLFKSSVKNGQFLRECRRCGMKKSI

SEQ ID NO: 6992 - protein, 108 aa, Bacillus licheniformis
MAEQQGNEKPFTAMGAGAQDQETAQIIERVGSLITGFGESIYELVQKNSGIDLREADFTKSENAELNQAIQNIISEYIQNLNNLNADLSGKIGESIQGIVTSKDQKDA

SEQ ID NO: 6993 - protein, 240 aa, Bacillus licheniformis
MAGHSKWKNIQRRKNAQDAKRGKIFMKLAKEIYVAAKEGGPDPESNASLRLVIDKAKNANMPNDNIDRAIKKASGSQDGKSYEEITYEGYGPSGVAVMVKCLTDNKNRTATSVRTAFSKNGGSLGETGCVSYMFDRKGYIAIEREDLEIDEEEFMLEVIDAGAEELETSEELFEIYTEPEQFEEVKKSLEERGYKLATSEITMVPQTYAEVDEALQEKVEKLIDVLEDDDDVQEVYTNVH

SEQ ID NO: 6994 - protein, 211 aa, Bacillus licheniformis
MDSKLKVFSGILLLTAGLSACGTNDAIDNGNNTRPIGYYSNDADRNAGLDNDGPVTEMLENMNGRNGATNVNNRAGNGNPVPTGDGTYSRGDMNYHNHLVNTADTGYDRPENRKISRNITGRVNKLNYVDESQAVVTNETVIIAVRSDKRLTNNERTQIRKAAKTFAGDRTVQVVEDDGAFTRLREMNDDPQNIRDRGDTTNNNLNRLRNQ

SEQ ID NO: 6995 - protein, 350 aa, Bacillus licheniformis
MKIHIVQKGDSLEKIAERYEVDFEELKKLNSQLSNPDLIMPGMKIKVPSGGVPVKKEEQLNMRKELPKKQQEHPFAKEKPKSKLDVEDIKPKEKPSVPYVPPVPNIGQSSLPEGDISNLYQSVNQLHQPYVPPKPYEHQEKGPNMYNPWTNEEENHMENVNYPNVPQPPNVGAAGDENKQFHGMPNVAAAGYHHHPYPYPFYPGGCWIPVSPVLPGSGLCHPWYPYPAQMPYMHQPSYVSPAEYDDDDNMGHDNAGHHGYHHQPMTAPAYAPYQPFPGFAPPNVGHAGDPNMAHGKEDDCGCGPGQFPGGFPGAAPYGQMPQMGAPYGMGGYGQQPAGGQMFNRPEDDED

SEQ ID NO: 6996 - protein, 369 aa, Bacillus licheniformis
MSILKVIHDRNAGMMPEVYKELTEEEMAGRILKIKKKFGARLFIPGHHYQKDEVIQFADATGDSLQLAQVAQKNKKAEYIVFCGVHFMAETADMLTSDEQIVVLPDMRAGCSMADMANMRQTNRAWEELTKLFGDTVIPLTYVNSTAEIKAFVGRNGGASVTSSNAARMLTWALSQKERILFLPDQHLGRNTAFDLGIPLSRMAVWDPIAEKLEYNGDMKDIIIILWKGHCSVHEKFTVANIKSVKERDPDINVIVHPECTHEVVALSDFSGSTKKIIDSINEAKPGSKWAIGTEMNLVSRIIQEHPDKQIESLNPDMCPCLTMNRIDMPHLLWSLEQIDKGEPTGVIKVDQDIAKDAILALNRMLTIR

SEQ ID NO: 6997 - protein, 279 aa, Bacillus licheniformis
MQRFILRNMLKEFFKEDIGRGDLTSEAVFDDNHQCEAVITAKDDGLFAGELVILEGFRLLDETIAVHMLKTDGEAVRKGETIARLKGRAASLMTGERVVLNLIQRMSGIATLTKQSIIRLNDPNIAICDTRKTTPGLRILEKYAVKTGGGSNHRFGLDGGIMIKDNHIAACGSISKAVEKARSACGHMVKIEVEIESEQELHEAIEAGADIIMFDNCPPETVKAFAEMTPAGIITEASGGISFENLPAYRGTGVHCISLGYLTHSAKSLDISMNVDLKK

SEQ ID NO: 6998 - protein, 524 aa, Bacillus licheniformis
MSHQTIIVVGAGAAALSFAASIPPSYEVVVMTKASVKDSNSTLAQGGIASAVLPRDSWSLHADDTLYAGCGHNQIEAVHDAIKDGQRLVDELILQHFPFDTDESGKLSLGKEGAHSVNRILHAGGDATGQELIRHLIGRLGPHVVLKEYETAADLWIEDGRCCGVWTKDSRGKTFLRKADFVVLAAGGCGNLFQINTNNRSVTSDAISLAYRAGAELADLEFVQFHPTLLVKDGRAHGLVSEAVRGEGAVLIDENGQRVMEGIHSLLDLAPRDVVSRAIHQKLACGSSVFLDISRISDFKSRFPTISSLCEKAGISIEEGRIPVSPGMHFLMGGVSVNKWGETAVPNLFVIGEAACTGFHGANRLASNSLLECIVFGRRAAERIQACQKPEPVRGQSPQPENVTYSVPLTDVKDIQKQMTDYAAIVRTEDELTKVKEWLERMPVQIVNVKEITIEQLELAHLWQTAKQMTASALLRTESRGGHYRSDCPAPDDKNWHGKQIVHTKGGIKIRQNEGIVKYAAVHT

SEQ ID NO: 6999 - protein, 392 aa, Bacillus licheniformis
MIYLDYAATTPASKEALDAFQKLSTDVYGNSSSLHDAGGKAENILRCCRQRMAELLSGEEEGVYFTSGGTEANFLAIHSILNGLPAGKKRFLMTEMEHQSIHILKRHLEMLGFDVDLMKPNASGIITTDILERHLRPDTGLVSIQHANSETGVIQPLAKLSAYLHKRDVLLHSDCVQTFAKIPVRIDELGADALSVSSHKVYGPKGVGAVYIRPGVNWKPVYPGTLHENGFKSGTVNVPGIGAFITAADSTINRMDAAHLKFQELRAGFLEGVKDRKLPVSLAVPDSANSHVLPHIIGCFFHSFEGQYTMLECNRRGICISTGSACSAGYHEPSNTMKALLIPRELALQFVRISFGCDTTSEHVDRLLDVLEDMMNEKGDHRIDRRIKTYGS

SEQ ID NO: 7000 - protein, 187 aa, Bacillus licheniformis
MRKETIGLTDGLKLTGAERRQQLLAWLKESEAPLTGSELAKRASVSRQVIVQDISLLKAKNEPIIATSQGYMYLRSALGKKQPVQRIIACDHEPEKTEEELNLIVDFGVTVKDVTIEHPVYGDLTASIRVSTRKEVADFVKKISSTNAAYLSQLTNGIHLHTLEADDEEKIEQACGALQKAGILIPE

SEQ ID NO: 7001 - protein, 285 aa, Bacillus licheniformis
MSMRVGYLGPEATFTHLAVCSCFSDADQQAFNTIPACMDAAMNGEIDLAVVPLENAIEGSVNLTIDYLIHEQPLYIVGEITAPIRQHLLVHPTRKEAWEDIQKVYSHSHAIAQCHKFLHSRFRSIPFEYATSTGAAAKYVSENPEENIGVIANEMAADTYGLDIVKRDVHDYEYNHTRFVMLHPDREASPPVNPQLKGRPKTTLLVTLPSDRSGALHQVLSAFAWRNLNLSKIESRPTKTGLGNYFFIIDIEMALDDVLIPGAIAELEALGCKVKMLGAYNAYTL

SEQ ID NO: 7002 - protein, 147 aa, Bacillus licheniformis
MKEETFYLVREDVLPEAMRKTLEVKKLIERKKAESVAEAVQKVDLSRSAFYKYRDAVFPFYTMVKEQIITLFFHLEDRSGTLSHLLQVVAESGCNVLSIHQTIPLQGRANVTLSVSTRGMDENIDLLMNKLRKLEFVEKVEILGSGA

SEQ ID NO: 7003 - protein, 428 aa, Bacillus licheniformis
MFVDQVKIYVKGGDGGNGMVAFRREKYVPKGGPAGGDGGKGGDVVFKVDEGLSTLMDFRYQRHFKAARGEHGMSKNQHGRNAEDMVVKVPPGTVVIDDDTKQVIADLTEHGQEAVIAKGGRGGRGNTRFATPANPAPQLSENGEPGKERYIVLELKVLADVGLVGFPSVGKSTLLSVVSSAKPKIADYHFTTLNPNLGMVETEDGRSFVMADLPGLIEGAHEGVGLGHQFLRHIERTRVIVHVIDMSGLEGRDPYEDYVTINKELEQYNLRLTERPQIIVANKMDMPDAEENLKAFKEKLTDDYPVFPISAVTRQGLRDLLFEIADRLETTPEFPLYDEEDMAENRVMYKLEDEEAPFEISRDPDGTFVLSGAKLERLFKMTDFSRDESVKRFARQLRGMGVDDALRARGAKDGDTIRLLEFEFEFID

SEQ ID NO: 7004 - protein, 192 aa, Bacillus licheniformis
MEETSKKREKNMDDKALTHELIHLLSHSRHDWMNKLQLIKGNLTLKKYDRVFEIIDEVVIEAQHESKLSNLRIPRAAYELLTFNWMAHSLTLEYEVIGQVKDLSAYEERLVVLIRKLFGIFDDAVLKGSDNHLTITLQTDGPDDRLVIFLDFHGVFTKLTGIKDFHHSLADFYEIKRFDVTDRECIAEIHIK

SEQ ID NO: 7005 - protein, 93 aa, Bacillus licheniformis
MLRLDLQFFASKKGVGSTKNGRDSEAKRLGAKRADGQFVSGGSILYRQRGTKIYPGENVGRGGDDTLYAKVDGTVKFERFGRNRKKVSVYPVA

SEQ ID NO: 7006 - protein, 129 aa, Bacillus licheniformis
MIHAKITRSRSNKDILGFEMSGHANFAEHGQDLVCAGASAVAFGAVNAVMKLTGIEPVIDLGEDGGFLSFRFPDGTDREAFEKAQLLLEGMIVFFLFDRTIFFLLLKSNDEQNIGGELHAKIRSSVFCI

SEQ ID NO: 7007 - protein, 102 aa, Bacillus licheniformis
MYAIIQTGGKQIKVEEGQTVYVEKLAAEAGETVTFDNVLFVGGENVKVGSPTVEGATVTGKVEKQGRAKKITVFKYKPKKNQHKKQGHRQPYTKVVIEKINA

SEQ ID NO: 7008 - protein, 288 aa, Bacillus licheniformis
MSKWTELFTKLHIHPLLWLVMAIGIMTGHIKALFCLMIIILIHELGHAAAAVYFSWRIKGIFLLPFGGTLEVDEHGNRPLKEELAVIAAGPVQHIWLQFAAWLLAVNSLISPHIFETFTFYNLTILLINLFPIWPLDGGKLLFLLFSKHLPYQKAQRMMLAVSCFCCAVLIAATLLVSPSQLSAWVLLVFLAASLYQEYRNRHYAHIRFLLERYYGNEREVRRLAPITVCAEQQIYEVMLMFKRGCKHPIIIEKDGQKLSQLDENEVLHAYFTDKRTTSSMEDLLLVY

SEQ ID NO: 7009 - protein, 263 aa, Bacillus licheniformis
MSHRADEIRKRMARKRKRKTPDKQPFSSDGKKRPLKPPAWTAFSEDEKGGDFPPPEGSSLLINGKHPLVKADALILKCLLSACLVLVSAIAYKGQFEPANQIKPVISQVFTEEFQFAALQNWYESKFGDPLAFFQPKGAKPSGQVEVNQDLAVPAVGKVQEKFSGQGIKVETEDETIRSMKEGYVIEVDKNPETGLTVVLQHADNSYTYYGQLKKADVALYDYIDKGTKLGTIEQDKNQKGIYYFAIKQGEEFVDPIQVITFE

SEQ ID NO: 7010 - protein, 142 aa, Bacillus licheniformis
MSNQLVPDIHKQAVFHASIEKVWEAVATSEGIAAWFMPNDFRPEIGCEFTLQSPFGPSPCKVIELDAPHRLAFSWDTSGWIVTFELKELSAEKTEFTLIHSGWGAPEETVSKAGEKQADVRNRMNGGWETIVNQKLRQAVEG

SEQ ID NO: 7011 - protein, 106 aa, Bacillus licheniformis
MTSAAKHDVFQAVSDPSRRKMLELLAGKELPVTDISSHFPMSRTAVSKHLRVLSEAGLVSGRKAGREKLYRLHPEPLAELQQWLAYFDMYWDNKLSLLKHKVENDQ

SEQ ID NO: 7012 - protein, 268 aa, Bacillus licheniformis
MGEAIVITSGKGGVGKTTTSANLGTALAILGKRVCLVDTDIGLRNLDVVMGLENRIIYDLVDVVEERCKIHQALVKDKRFDDLLYLLPAAQTSDKSAVLPEQMVKLIQQLKQDFDYIVIDCPAGIEQGYKNAVSGADKAIVVTTPEISAVRDADRIIGLLEKEENIEPPRLVVNRIRNHLMKNGDTLDVDEVIQHLSIELIGIVADDDEVIKASNNGEPVVMDPNNKASIAYRNIARRVLGESVPLQSFEEENKGVFAKIKSFFGVRA

SEQ ID NO: 7013 - protein, 226 aa, Bacillus licheniformis
MKTQKQQYVTIKGTKNGLTLHLDDTCSFEELLYGLQDMLSLEHYMDGKGQKINVLVKLGHRYVTEEQEQILTDVITEKQNLFIHSIESEVMTKDEANRLKAESEIISVAKIVRSGQVLETEGDLLLIGDVNPGGMVKAGGNIFILGSLRGIAHAGFNGNKRAVIAASDMRPTQLRINHVLNRSPDNIQEGNDMECAYLDENENMVIDRLQQLAHLRPSLTRLEGGM

SEQ ID NO: 7014 - protein, 172 aa, Bacillus licheniformis
MKRFLLPVVMMFVLVSDSVYADFVNLPFVTEEQQLIPRFLLLVLVFMTAYVNQPFAITYGFIFGLLYDINYTDLLGVYMFGFAGICYLSSKAFKVLQTNALVVIFISLLAVCVLEFYQYGVQMLIRPEIMPFHQFVLGRLLPTLALNAVGGLLLIYPFKWFFTSLKKELRNE

SEQ ID NO: 7015 - protein, 302 aa, Bacillus licheniformis
MPQFFTNKRLMLLLLCIIILVAMIGFSLKNDRNATWPEKFIGDTTGVFQTIFHTPAQFFAGFFENIEDLKNTYSENERLRKKLDGQTQYEAKLQELENENKSLRKELGHLKSIKDYTPILATVIARNPDKYEWWNLITINKGSKHGVEKDMAVTDENGNLIGKIKSTKVNNFTSTVQLLSATDRNNRISTVIAADKGKKTVNGIINGYDSDKKALSMEIIEPDEDREVKKGDLVETSGAGGVFPKGLTIGKVTEVEPDSYGLTKIAYVEPAADMYNLDNVIVVDRTLDTVDVDKMDDEEEGS

SEQ ID NO: 7016 - protein, 336 aa, Bacillus licheniformis
MFGIGARDLGIDLGTANTLVFVKGKGIVVREPSVVALQTDTKQIVAVGNDAKNMIGRTPGNVVALRPMKDGVIADYETTATMMKHYISKAVKNKGLFARKPYVMVCVPSGITAVEQRAVIDATRQAGARDAYPIEEPFAAAIGANLPVWEPTGSMVVDIGGGTTEVAIISLGGIVTSQSIRVAGDEMDEAIITYIRKTYNLMIGDRTAEAIKLEIGSAEASENGESMEIRGRDLLTGLPKTIEITEKEITAALRDTVTAIVDAVKNTLEKTPPELAADIMDRGIVLTGGGALLRHLDKVISEETKMPVLIAEDPLDCVAIGTGKALEQIHLFKGKN

SEQ ID NO: 7017 - protein, 224 aa, Bacillus licheniformis
MKLKDFPDEERPRERLLNTGAESLSNHELLAILLRTGTKKESVLQLSSRLLQTFDGLRLLKEASAEELSSISGIGRAKAVQILAALELGRRIHSLACKDRYVIRFPEDAANFLMGDMRFLSQEHFVCVYLNTKNQVIHKRTVFIGSLNSSIVHPREVFKEALKRSAASFICVHNHPSGDPAPSREDIEVTQRLHESGQLLGIELLDHIIIGDQKFVSLKEKGYL

SEQ ID NO: 7018 - protein, 190 aa, Bacillus licheniformis
MTRQLILASQSPRRKELLDLLQIPYSIVTSNAEEKLIRNFSPAENVKWLAEQKVRAVAEQYPDAVVLGADTIVYYDGAYLGKPKDAEDAERMLSMLSGQTHSVLTGVCIKDGERCETFFEETEVSFWPLEEKEISAYIATGEPFDKAGSYGIQGKGALFVKQIKGDYYTVVGLPISKTMRMLKTFDLHSF

SEQ ID NO: 7019 - protein, 343 aa, Bacillus licheniformis
MKKRKSKKNSAKKAPEQDPLKVMINGREETIYGNEKEFSNRNEEKKFTFSNWEEKRKAEREISASKEDGTHETGEFTWTPPDEEETVYKDDPKVVAPYQKKNEPKNNRKTKTSLTYPVKRFAATIVFAVLLGTGLGLFALNLATHKEGVPASGSLGADAENGQTVKAGDSGAEEKKSGEKNSGQAGESFNSFAVQAGKFSSKEGADTLASQIADKGYAAVSIAKDDGFYVIAGITGEKQMTSELGKILIENDFEAWGGKELPVAIESGLLEPFKEAAELSAKAILGAEVTSQNIADVKAQLDGAQSKGSEEVKKSILEAVNLLEKPTAANGWKSQQLLLGQIK

SEQ ID NO: 7020 - protein, 259 aa, Bacillus licheniformis
MKFDSARLITMFIFYLFTAGLVLGSFFNSAGRRIPEKISLIAPRSLCRVCKRQLGFSELIPVLSYLMQRGRCKGCQTPLSIVYPAVELSAAILFAFAGMHVGHEGELVIVLALISLLLIVFVSDVTHMIIPDAVLCFFLPVFAVGRFLVPLEQWHSSLSGAMAGGMLPLLTLLLTKGGIGWGDVKLFAVIGMALGSRLLVLAFFLSAAAGTVLGLIALLAGKLKKNEPMPFAPAILAGTLTSCFYGEPMIEWYLQTAWW

SEQ ID NO: 7021 - protein, 432 aa, Bacillus licheniformis
MFKTFDEALSWINGRLKFGVKPGLERMEWLLRKLGHPEKKLNAVHVAGTNGKGSTIAFLRSVLNEAGYTAGTFTSPYIITFNERISVDGAPISDEEWTALFNEVGPLVLELEKTEFGAATEFEIITACAFLYFAKYRRTDFVIFETGLGGRLDSTNVVKPMLTVITSIGHDHTAILGGTLKEIAAEKAGIIKRGVPVITAVHQHEAAEVIKRKAMETESAFISLHEDCQLYGELSLPEGEQFSLKTPLHHYEGIETSLIGTHQRQNASLAILAAEWLTAEKHAAIGEKELKRGIRNAGWPGRFEKVLNKPLVYIDGAHNKEGMERLAETISSHFAGRNIHVCFSALKDKPYRDMIRKIESFASSIHFTSFDFPRAESAQKLFEQSTADYKTFDEDIASVFRYIEEKAEEEKAVVVITGSLYFISAVRAALTE

SEQ ID NO: 7022 - protein, 880 aa, Bacillus licheniformis
MDNQELTMPTKYDPSAVEKDRYDYWVNGKFFEAKNDPEKEPYTVVIPPPNVTGKLHLGHAWDSTLQDIVTRMKRMQGYDVLWLPGMDHAGIATQAKVEAKLREEGKTRYDLGREKFLEETWNWKEEYADFIRSQWAKLGLGLDYSRERFTLDEGLSKAVREVFVKLYEKGLIYRGEYIINWDPATKTALSDIEVIYKDVQGAFYHMRYPLKDGSGSIEIATTRPETMLGDTAVAVHPEDERYKHLIGKTVILPITGREIPIVGDDYVDMEFGSGAVKITPAHDPNDFEIGNRHNLERILVMNEDGTMNDNALQYKGMDRFECRKQIVKDLQEEGVLFKIEEHTHSVGHSERSGAVVEPYLSTQWFVQMQPLADAAIELQKSEGKVNFVPDRFEKTYLHWMENIRDWCISRQLWWGHRIPAWYHKETGEIYVGVEAPEDAENWEQDKDVLDTWFSSALWPFSTMGWPDIDEEDFKRYYPTNVLVTGYDIIFFWVSRMIFQGIEFTGERPFKDVLIHGLIRDDQGRKMSKSLGNGVDPMDVIDKYGADSLRYFLATGSSPGQDLRFSFEKVESTWNFANKIWNASRFALMNMDGMTYEELDLSGEKSVADKWILTRLNETIETVTQLADKYEFGEVGRHLYNFIWDDFCDWYIEMAKLPLYGEDEAAKKTTRSILAYVLDQTMRLLHPFMPFLTEEIWQHLPHEGESITVAKWPEAVKEYTDTEAAADMKLLVEVIRAVRNIRSEVNTPLSKQIELYIKTSTPEIAERLEENRSYVERFTNPSLLQIGTDIQAVDKAMTAVVSGAELILPLEGLINIDEEISRLQKELDKLTKEVERVQKKLSNEGFMKKAPAHVIEEERAKEADYTAKREAVEKRIAELKN

SEQ ID NO: 7023 - protein, 63 aa, Bacillus licheniformis
MRKKFNTYSFQPWLKQVRLVAVQVVLPITIFQGIRTIIFPTTFDVLLLGILIFLACAFHLDWI

SEQ ID NO: 7024 - protein, 340 aa, Bacillus licheniformis
MEGIQSVLNEYGLTPEYMESVSSKVWKVYTDHGVFALKKLAASRNTRFTEQMIMLEEKGYRQFVPVYRNRTGEFLTQAGEDVCYLMPWLTLEREEERDQKHEYMFKEIALLHQRTEKELGVRREEILGHYERTKRKWEQQKQKYEAFIMKAENEWYMSPFQLQAAMYFKETISAADFALARLEDWHEAMREKESARMVLNHGHLSVRHFLYNDTGTGYFTNFEKAGHAPPANDLIVFFTRMFKTNPVMCTECVNWFYTYHNVYPLREEEIGLFLSYMAYPGPVFGVLNRYEHEKGLGEKEACTRLLKAYWQMKNAEPLVMSIHETEENRKLQEETESPSS

SEQ ID NO: 7025 - protein, 457 aa, Bacillus licheniformis
MPQNNRLQFSVEESICFQKGQEVSELLSISLDPDITVQEVNDYVSIRGSLELTGEYNIDQTREYAELPATSRFVEDVKLKGDGSAELTHCFPVDITIPKDKVNHLNDVFVFIDAFDYQLTDARMLTIQADLAIEGLLNVSGEAGEEEPRTMPAAVHPEEELEPAYRSPSNDEDQGEEKEYLIQLDRPYEEQDEEQAEEHDTGEETVPIYQSFLGNDTEEAKPFFTASLSAAERTKREIENQKEASLEQPEEEYKLKREKVEEEPEEYELKREKVEEEPEEYELKREEAEEEPELSHSSYQPHEELKENPFYSVPPLLKEDQNDREPEAFEVEVTQEAEAIDEEEEAGHTIEIPEYSFHEQTEPEEERDEMQAADEQEVSAKENDNALYLTKLFTKQGEEEFTRMRMCIVQQNDTIDLLCERYDINVQQLIRMNSLSLDEELKEGQILYIPDYQNSHA

SEQ ID NO: 7026 - protein, 431 aa, Bacillus licheniformis
MRSYEKSKAAFEEAQRVMPGGVNSPVRAFKSVNMDPIFMERGKGSKIYDIDGNEYIDYVLSWGPLILGHSNEKVVKEIQKAAEHGTSFGAPTELETELAELVIDRVPSIEIVRMVSSGTEATMSALRLARGYTGRNKIVKFEGCYHGHGDSLLIKAGSGVATLGLPDSPGVPESIAKNTITVPYNDLESMKLVFQEFGDDIAGVIVEPVAGNMGVVPPVKGFLEGLRELTETHGALLIFDEVMTGFRVDYNCAQGYFGVTPDLTCLGKVIGGGLPVGAYGGKAEIMEKIAPSGPIYQAGTLSGNPLAMTAGLETLKQLTPESYREFSRKADRLEKGISEAAEKNGIPCTFNRAGSMIGFFFTNGPVINYDTAKQSDLGLFAEYYKGMADEGVFLPPSQFEGLFLSTAHTDDDIEHTIKAAERVFERISRSR

SEQ ID NO: 7027 - protein, 324 aa, Bacillus licheniformis
MEASFQRHRRLRTTAGMRKLVRETELRASDFIYPIFVTEEENVKSEVPSMPGVYQLSLDRLKEEMEEVASLGIQSVIVFGVPEHKDDVGSGAYHDHGIVQKAIAQIKQDFPELVVIADTCLCEYTDHGHCGLVENGEILNDESLVLLAKTAVSQARAGADIIAPSNMMDGFVAAIREALDQEGFTNVPIMSYAVKYASAFYGPFRDAAGSSPQFGDRKTYQMDYANRREALREAKSDVEEGADVLIVKPTLSYLDIVREVKNEFNLPVVGYNVSGEYAMVKAAAQNGWIEEKALVLEMLTSMKRAGADLIITYFAKDAAKWISE

SEQ ID NO: 7028 - protein, 263 aa, Bacillus licheniformis
MKHDLPLEGKKVLVTRNKAQAQSFREKVEALGGEAVLTSLISFRPALPPEQARRFRADLESADWLVFTSVNGAKFFFSYLKDAGLCDPPASKAKVAAVGEKTARYLRDRGLSVDLMPELYVAEHLAEALKQNAGRHDKVVVLKGNLSRDVIKKTISPLGIQVSEWILYETVRDERGILDLKEAAKHASFDFVTFTSSSTVHTFMSILKEESLAWAEKNRTAFITIGPLTKKALSDYGIPSYMPDVYTIDGMLREMCRISRKGE

SEQ ID NO: 7029 - protein, 313 aa, Bacillus licheniformis
MRNIIVGSRRSKLAMTQTKWVIKKLEELNPDFTFEIKEIVTKGDRILDVTLSKVGGKGLFVKEIEQAMLSGEIDMAVHSMKDMPSVLPEGLMVGCIPKREDARDVLISKGRQKLADLKQGAVVGTSSLRRSAQLLQMRPDLEIKWIRGNIDTRLKKLETEDYDAIILAAAGLSRMGWKDDVVTEFLDPESCLPAVGQGALAIECRGSDEELLSLFSRLNDRYTQLTVTAERAFLHAMEGGCQVPIAGFAKMDEDGVIELTGLVASPDGKTVYRETVKGKDPEAVGRECAAVMSEKGAKALIDRVKQELEDHEA

SEQ ID NO: 7030 - protein, 276 aa, Bacillus licheniformis
MTDTLLARLNEVTIVLYAFTVLFYFIDFLQHNRKAGKAAFWLLSIVWILQTVYLFYFMQYTDQFPVLNNAQGLYFYAWVLVTLSLVLTKLLKVEFLVFFTNLIGFSMAAIHTFTPTAQQSAELSGRLVSELLIIHITMAILSYGAFSLSFVFSVLYLFQYRLLKKKKWGKWLLRIEDLSKLDHMAYVLNIIGVPMLLLSLILGIIWSYVSLETLYWADPKVLGSIVLLFLYGYYLFIRIVKELQGRIAAMWNAASFLVLLINFFLLGSFSQFHWFS

SEQ ID NO: 7031 - protein, 453 aa, Bacillus licheniformis
MHILVVGLDYKSAPVDIREKLTFQPDELGQAMAQLKEEKSILENIIVSTCNRTELYAVVDQLHTGRYYMKMFLANWFGLSKEDISPYLKFYENDGAVEHLFRVSCGLDSMVIGETQILGQVRTSFKLAQEEKTIGTVFNYLFKQAVTVAKRCHAETDIASNAVSVSYAAVELARKIFGDLSDKHVLILGAGKMGELAVQNLHGHGIGQVTVINRTFSKAKELAGRFSGAAKSLNELQCALMEADILISSTGASGYVVTKEMIEHVNKLRKGCPLFMVDIAVPRDLDPALSEVEGVFLYDIDDLEGIVEENLKERQAVAEEVELIIEAEIVSFKQWLNTLGVVPVISALREKALTIQAETMQSIERKLPHLSTREKKLLNKHTKSIINQLLRDPILKVKEFASEADAEEKLALFTQIFDIEEAAFPDGERQDERQPVHAFKRQNPQGLTSIASE

SEQ ID NO: 7032 - protein, 161 aa, Bacillus licheniformis
MKKKSVLLPLLLIAVAVYAFLRSGRISLFDGQEEWSVLAGLVGLALFYQGQKEADSAHSFAGLLMTAIGVYFTFKEDYFSRADDFAVIVLIFGAALLVKSFKTKEYQYESLLMIAVALYLYFFRQIAAWLKSVNIETAYVEAYWPAAFIAVSLLLLFLKRK

SEQ ID NO: 7033 - protein, 195 aa, Bacillus licheniformis
MKVTKSEIVISAVKPEQYPEGGLPEIALAGRSNVGKSSFINTMINRKNLARTSSKPGKTQTLNFYIINDVLHFVDVPGYGFAKVSKTEREAWGRMIETYLTSREELKAVVQIVDLRHAPSQDDVMMYDFLKHYEIPVIVIATKADKIPKGKWEKHAKVVKETLNIEKEDRLILFSSETKKGKQEAWSAIEQMIAR

SEQ ID NO: 7034 - protein, 774 aa, Bacillus licheniformis
MADETKRNIPLLPLRGLLVYPTMVLHLDVGREKSVQALEQAMMNDHMIFLATQKDISIDEPDEDEIFTFGTYTKIKQMLKLPNGTIRVLVEGLQRARILEYHDLDEYTSVKIERIDEETEKDVEDEALMRTLLDHFDQYIKISKKISAETFAAVTDIEEPGRMADIVASHLPLKLKDKQEVLETIDVKARLNKVIDLIHNEKEVLEIEKKIGQRVKRSMERTQKEYYLREQMKAIQKELGDKEGKTGEVQKLTEKIEQAGMPDNVKETALKELNRYEKIPSSSAESSVIRNYIEWLISLPWNDATEDRLDLKLASQILDEEHHGLEKVKERVLEYLAVQKLTRSLKGPILCLAGPPGVGKTSLAKSIAKSLGRKFVRISLGGVRDESEIRGHRRTYVGAMPGRIIQGMKKAGKNNPVFLLDEIDKMASDFRGDPASAMLEVLDPEQNHTFSDHYIEETFDLSKVLFIATANNLATIPGPLRDRMEIITIAGYTEVEKVEIVKDHLLPKQLKEHGLKKSNLQIREQAVLDVIRYYTREAGVRNLERQIAAICRKAAKLIVSGERKRITVTDKNLEDYLGKRMFRYGQAELDDQIGVVTGLAYTTVGGDTLSIEVSLSPGKGKLILTGKLGDVMRESAQAAFSYVRSKAEELNISPDFHEKHDIHIHVPEGAVPKDGPSAGITMATALVSALTGRPVSRNVGMTGEITLRGRVLPIGGLKEKALGAHRAGLKTVIMPKDNEKDIEDIPNSVREGLTFIPVAHLDEVLKHALVGEEK

SEQ ID NO: 7035 - protein, 551 aa, Bacillus licheniformis
MSWTSIALFVQLFFGIIIGLYFWNLLKNQRTQKVTIDRESKKEMEQLRKMRSIHLSEPLSEKVRPTAFKDIVGQEDGIKALKAALCGPNPQHVIIYGPPGVGKTAAARLVLEEAKKNKRSPFQEHSAFVELDATTARFDERGIADPLIGSVHDPIYQGAGAMGQAGIPQPKQGAVTHAHGGVLFIDEIGELHPIQMNKMLKVLEDRKVFLESAYYSEENTQIPKHIHDIFQNGLPADFRLIGATTRMPDEIPPAIRSRCLEVFFRDLEKHELKTVAKKAADKIQKKVAEEGLDLLTRYARNGREVVNMMQIAAGMALTEERDEVTVEDIEWVIHSSQLTPKYEQKIASKPQVGIVNGLAVHGPNSGSLLEIEVTVNQAADKGSINITGIAEEENIGNQSKSIRRKSMAKGSVENVMTVLRTMGVKASDYDIHVNFPGGIPVDGPSAGIAMAAGIFSAIHKIPIDHTVAMTGEISLNGRVKPIGGVIPKIKAAKHAGAKTVIIPHENVQSILKRIEGIHIVPVKTLQEVLDLVLVNPPSEMPDGVQMKRESV

SEQ ID NO: 7036 - protein, 421 aa, Bacillus licheniformis
MFKFNEEKGQLKCSFCGKTQDQVRKLVAGPGVYICDECIELCTEIVEEELGSEEEVEFKDVPKPKEIREILDEYVIGQDQAKKSLAVAVYNHYKRINSNSKVDDVELSKSNISMIGPTGSGKTLLAQTLARILNVPFAIADATSLTEAGYVGEDVENILLKLIQAADYDVEKAEKGIIYIDEIDKVARKSENPSITRDVSGEGVQQALLKILEGTVASVPPQGGRKHPHQEFIQIDTTNILFICGGAFDGIEQIIKRRLGQKVIGFGSDNKHEDLEKEALLSKVLPEDLLRFGLIPEFIGRLPIIASLEPLDEKALVEILTKPKNALVKQYRKMLELDDVELVFEDEALTEIAKKAIERKTGARGLRSIIEGIMLDVMFDLPSREDIEKCVITGKTVTDGEPPRLIMKDGTVVNKDKKTSA

SEQ ID NO: 7037 - protein, 424 aa, Bacillus licheniformis
MSVKWEKQEGNEGVLTVEVDADTFNKALDDAFKKVVKQVSIPGFRKGKVPRGLFEQRFGVEALYQDALDILLPVEYPKAVEEAGIEPVDRPEIDVEKIEKGENLIFTAKVTVKPEVKLGEYKGLGIEKDDTAVTDEDVQNELKSLQERQAELVVKEDGKVEEGDTVVLDFEGFVDGEAFEGGKAENYSLEVGSGSFIPGFEDQLVGLEAGAEKDVEVTFPEEYHAEELAGKPAVFKVKIHEIKAKELPELDDEFAKDVDEEVGTLAELTEKTKKRLEEAKENEADAKLREELVLKAAENAEADIPQAMIDTELDRMMKEFEQRLQMQGMNLELYFQFSGQDENALKEQMKEDAEKRVKSNLTLEAIAKAENLQVTDEEVEEELSKMAEAYNMPVENIKQAIGSTDGMKEDLKVRKAIDFLVENR

SEQ ID NO: 7038 - protein, 335 aa, Bacillus licheniformis
MKHDKKNSKIIPFPNVKERLVHKGMGALKEKNYHEALRLFSEAKRYNDEESDIYLGMAICLLEIGELEEAKGICEKMLKEGHGHYFTVLQVYMTILIQLRQYEKVKETIEAVLEENKLPPESAEQFYKLLDFSRKMTEDPGPEDITEDLPETEEVDQERLLNDTEEQVKLLHGLKDRNLTSYIGLLKTILQNPSAHPVVKTMILQLLAESDHEKPTLVAKFGDSMTINPTETVKPDDMPILKHVLSVLDDTLGNENPTLYQAVEELWRRHIYVLYPFQPKYSNRELWAAALHKVGYEMHGIDIDKEELHILYEFNDRQLDEACALIKDIEEISYL

SEQ ID NO: 7039 - protein, 199 aa, Bacillus licheniformis
MEPLKTHNGIAAVLNRINVDTDQIIPKQFLKRIERTGYGRFAFFDWRYLDNGDPNPDFELNRPEYKGASILIAGENFGCGSSREHAPWALDDYGFKIIIAPSFADIFHQNCFKNGMLPIRLPYEAWKELAEQYEYQSLTMTVDLEKQTITDHAGRQIAFEVDPHWKEMLLNGYDEISLTLLLEEEIEQFEKQRSSWLQA

SEQ ID NO: 7040 - protein, 472 aa, Bacillus licheniformis
MMPRTIIEKIWDQHVIKKGEGKPDLLYIDLHLIHEVTSPQAFEGLRQKNRKVRRPQNTFATMDHNIPTVNRFEIKDDVAKRQVSALERNCEEFGIRLADLSSVDQGIVHVIGPELGLTLPGKTIVCGDSHTSTHGAFGALAFGIGTSEVEHVLSTQTLWQQKPKTLEIRVDGKLQKGVTAKDVILAIIGKYGVKFGAGYVIEYTGEVFRNMSMDERMTVCNMSIEAGARAGLIAPDETTFEYVKTKKYAPKGEDFEKAVEEWKNLKTDPGAVYDRTIVMDGSAISPMVTWGINPGMVLPVDETIPGPEAFLQEDDKKEAQRAYEYMGLEPYKKIEDITIEHVFIGSCTNSRMTDLRQAAEMIKGQKVADGVRAIVVPGSQSVKIQAEKEGLHKIFIEAGFEWRESGCSMCLSMNNDVVPEGERCASTSNRNFEGRQGKGARTHLVSPAMAAMAAIHGRFVDVRKYYQETTAV

SEQ ID NO: 7041 - protein, 370 aa, Bacillus licheniformis
MKKRIALLPGDGIGPEVLDAAVDVLKSVAEHYQHEFEFEYGLIGGAAIDEAGAPLPEETVAACKAADAILLGAVGGPKWDQNPSELRPEKGLLAIRKQLDLFANLRPVKVFESLAGASPLKTEYIEGVDFVIVRELTGGLYFGKPSEQYVNQNGEEEAVDTLFYKKSEMERVIREAFQMAQSRKGKVTSVDKANVLESSKLWRKTAEEVAKEFPDVKLEHMLVDNAAMQLIYAPGQFDIIVTENMFGDILSDEASMLTGSLGMLPSASLSSSGLHLYEPVHGSAPDIAGQNIANPLAAILSAAMMLRTSFGLEAEAQAVEHAVDQVLRAGKRTKDLAKGSEHCTTQSITGEVKAALADDNAISNIMTAYV

SEQ ID NO: 7042 - protein, 518 aa, Bacillus licheniformis
MRKINFFDTTLRDGEQSPGVNLNTQEKLAIAQQLEKLGVNIMEAGFPASSPGDFNAVKEIARTIKNCSVTGLARSVKGDIDSAWEALKDGAEPRLHIFIATSDIHLKYKLKKTREQVLEQAVAMVKYAKERFPIVQWSAEDACRTDLPFLAEIVSEVIAAGADVVNLPDTVGYLAPAEYGNIFRYIKENARNADKVQLSAHCHDDLGMAVANSLAAIENGADQVESVINGIGERAGNASLEEIAVALHIRKDFYQAESTIQLNEIKRTSDLVSKLTGMAVPRNKAVVGDNAFAHESGIHQDGFLKEKTTYEIISPELVGVKTDALVLGKHSGRHAFKDKLQNLGFQLGEEEINKFFNIFKELTGKKKEFTDEDLISLILEEKTADRKIGYDFISLQVHYGTSQVPTATVSLKDQETDQVIQEAATGAGSVEAVYNTLKRCMDKEVQLLDYRIQSNRKGQDAFAQVYVRVMIDGKESGGRGVAQDVLEASAKAYLNAVNRYLVLKTNTEGLSKQAAVGS

SEQ ID NO: 7043 - protein, 342 aa, Bacillus licheniformis
MVKVYYNGDIKENVLAGKKVAVIGYGSQGHAHALNLKESGVDVIVGVRKGKSFAKAEEDGHQVFTVREAAEQADIVMVLLPDEQQQKVYEAEIKDGLQAGNSLVFAHGFNVHFHQIVPPADVDVFLVAPKGPGHLVRRTFEQGAGVPALFAIYQDVTGEAKDKALAYAKAIGGARAGVLETTFKEETETDLFGEQAVLCGGLTSLVKAGFETLTEAGYQPELAYFECLHELKLIVDLMYEEGLAGMRYSISDTAQWGDFVSGPRVVDEKVKESMKEVLKDIQNGTFAKEWIVENQVNRPRFNAINASENEHQIEVVGRKLREMMPFVKQGKKKEAVVAGAKN

SEQ ID NO: 7044 - protein, 172 aa, Bacillus licheniformis
MKRIITLTVLNQSGVLNRITGLFTKRHYNIESITVGHTETAGISRITFVVHVADEKETEQLTKQLNKQIDVLKVTDITNQSIVQRELALIRVVSPPSSRTEINGVIEPFRASVVDVAKDSVVIQVTGESSKIEALIELLKPYGIKEVARTGTTAFARGTQQKPASIKTISIV

SEQ ID NO: 7045 - protein, 574 aa, Bacillus licheniformis
MGTNVQLDAENAQCTQTMAGASMLIEALKQENVEVIYGYPGGAVLPIYDKLYGSGMFHVLTRHEQGAIHAAEGYARISGKPGVVIATSGPGATNLVTGLADAMIDSLPLVVFTGQVATSVIGSDAFQEADVIGITMPITKHSYQVRNAEDLPRIIKEAFHIATTGRPGPVLIDIPKDIAVVEGEFRYDHDIHLPGYQPTKEPNYLQIRKLVEAVSAAKKPVILAGAGVLHGKASEELKNYVEQQQIPVAHTLLGLGGFPADHPLFLGMAGMHGTYAANMALYESDLLISIGARFDDRVTGNLKHFAKYAKVAHIDIDPAEIGKNVHTHIPVVGDSKLVLTELIKQNGKPSASDEWKKQLAAWKTEYPLWYEENETEGFKPQKLIEYIHRYTKGEAIVTTDVGQHQMWAAQFYQFQKADRWVTSGGLGTMGFGLPAAIGAQLADKDATVVSILGDGGFQMTLQELSVIHDLNLPIKVVVLNNRCLGMVRQWQEIFYDERYSHSKFTSQPDFIKLSEAYGIKGVRITSEEEAEEKLEAALTSNEPMVIDVQVAQAEKVFPMVAPGKGLHEMVGVKP

SEQ ID NO: 7046 - protein, 304 aa, Bacillus licheniformis
MGDQKDQWIFLNDKLVKKEDAKISVYDHGFLYGDGVFEGIRVYDGNIFRMQEHMDRLYDSARSIMLEIPYPQEELTQHVLKTVEKNGLKDAYIRLVVSRGAGDLGLDPNNCSNPSVIIIVEPLAIFPKHLYETGIDIVTVPTRRNRPDVLSPKVKSLNYLNNILVRIEAHMAGVTEALMLNDQGYVAEGSADNVFIYKNGKLLTPPGYIGALEGITRNAIIEIARELGYEVKEEPFTRHDVYTAEEVFLTGTAAEVIAVVKVDGRKIGDGKPGVHTNRMLEKFRERVVREGLKVSLKDQSLSVS

SEQ ID NO: 7047 - protein, 75 aa, Bacillus licheniformis
MYRTFPAHSVPRVRQYPGYFGYPVTYVYNPSAHGPYTYYPYGGVFTTPTLGFGIGYPGISVPAVHAFTGGFRDNE

SEQ ID NO: 7048 - protein, 460 aa, Bacillus licheniformis
MHTLEKMEQTNFQTARDYVTQAYETVQKRNFYESEFLQAVKEIFDSLVPVLARHPKYIEHRILERIAEPERMITFRVPWVDDEGNIRVNRGFRVQFNSAIGPYKGGIRFHPSVNASIIKFLGFEQIFKNSLTGLPIGGGKGGADFDPKGKSDREIMSFTQSFMNELYRHIGPDTDIPAGDIGVGAREVGFMFGQYKKIRGRYDAGVLTGKGLEYGGSLTRKEATGYGLVYFVEEMLKDQGMRFENSTVVVSGSGNVALYAMEKAAQFGAKVVACSDSDGYVYDEKGICLETVKRLKEDGNGRIREYVSEHPEAHYFEGCTGIWSIPCDIALPCATQNEIDEEAAEVLISNGVKAVGEGANMPSEEGAVKRFLDAGVLFGPAKAANAGGVAVSALEMAQNSARLHWTAEETDAKLRAIMADIHKRSVEAASEYGRPGNLLDGCNIAGFIKVADAMIAQGVV

SEQ ID NO: 7049 - protein, 84 aa, Bacillus licheniformis
MDDKKEMSNVETQRNFLTAEEFPEGAYGAAQGKDEPVENKSTPWKEGQQYYSNFAYEFRNLHQGTPRQYPGAHPTHDEEDQNEE

SEQ ID NO: 7050 - protein, 163 aa, Bacillus licheniformis
MTKQQQNQQQKQKQQKQKHEQLLGANITDTELAQEFGNIQQQLAQLEQTVNQMGSQQQGQSGQQSSQLSQGINQLKQQIQQFSSQSQQQMQQTDQQIQQSIQQAVQQLNQALQGIQTNQAMNQMSQALQQAQQSFNQQGQQGQQGQQNQQNQQQNQNFQQPLQ

SEQ ID NO: 7051 - protein, 73 aa, Bacillus licheniformis
MAQQSVKATVFKANAPSETTKQIYEDQFDYKGNDIIEPPYSLKELKSTAEYSTILQQCIHAYKTKYSRFLVLM

SEQ ID NO: 7052 - protein, 431 aa, Bacillus licheniformis
MTVKEVNPHFEDFLFDWNQKFQLLVGGYGSSKSYHIALKLILKLLEEKRTVLVIREVYDTHRDSTFSHFEGIINDLEIDHIVRCMTSPMQVRFPNGSRIIFKGLDKPAKLKSINNISIIWIEECSEVKYEGFKELLGRLRHPTLPLHMIFSTNPVGEDNWTYKHFFKDDLNNRFVLDDKELYEKRTIVLNDTYYHHSTAEDNLFLPESYVRQLDELKEYDPDLYRIARKGHFGVNGVRVFPQLEEWPHDEVMQAVSNIDCPIKRVGMDFGFEESYNAVVRLAVDHKKKYLYIYWEYYKRGMTDDRTAEELQEFKNTQELIKADSAEPKTIQYFRQQGFNMVGAHKYQGSRLQYTKKIKRFKKIICSGQCRNTIFELKPLTYKKDKLGSIIEDEFKIDPHTLSAIWYALDDYEVTDLKEKPKIRQRPNRERR

SEQ ID NO: 7053 - protein, 136 aa, Bacillus licheniformis
MQRISRIENGLSEKQRRVLQQMRKVKDIVQTPDKNGLVKPVPVMNERLVVTEIEETEMRAIDDILNIEEALTRVTDKRLKAIRQKYDMIRLMDEQELKLRGIYLSNETKQAELERLTARPVDNSVNITITRKGDGK

SEQ ID NO: 7054 - protein, 128 aa, Bacillus licheniformis
MARPRDPRRDEAFRLWKESSGTKKLKDIADELGVSSSTVRKWKAIDKWEDKIKGSAPKSNGSAPFRPSAPIGNKNAKGNKGGNAPPGNENAKGNAAPKGNKNSARTGEYETIMWDFLNEDERQLFGEI

SEQ ID NO: 7055 - protein, 82 aa, Bacillus licheniformis
MATENTNIRSCDDKEKEKLLLLHSAELLENISQSKEKYRKIIQAGITQWVKDFQSGHIKVNTVEDLKKLIELDIQLQKDEEI

SEQ ID NO: 7056 - protein, 257 aa, Bacillus licheniformis
MTVVPEKLYCRACKRKTNHQIVKNEHDNELKYSISNLDYDEEIDFQFNEDYAIVQCRGCDAIAFLKIYGDEDMFHIVGSNYHTDREYFVEYTVFPEEPKKEDPVEQLLQFKEKYEFDHLPNLINGIRNETINAYRQRMNLLCNTGIRMLIESICMVNGIDKRPKIKKGEPVLDGHKNPVMVNLNLVQKINELKEKNIIDEEQRRILLEIKDVGNQTVHEIFRPKRRDLLLYLETLDLILFNIYELPHIKITNSPSPS

SEQ ID NO: 7057 - protein, 91 aa, Bacillus licheniformis
MGDITKRIEGKESNFNTILVKNSLVPPTLGSGSVFVRYDEPYYISERDIILMQSFPLDYDFMDASVQYVCGMSVPPVMMKKISEQIYNQWF

SEQ ID NO: 7058 - protein, 238 aa, Bacillus licheniformis
MALKYSVHSLGAGVPLWGYKLAGYDLLGNCEIDPQMMKIYRKNHNPIYPFLMDIRDFNKMENLPDELFDLDIFDGSPPCSVFSIAGDREKAWGKEKAFRKGQAKQSLDDLFFHYLDAVERLRPKIFVAENVKGMVSGNAKGYVKLVIERTKEIGYDVQLFLLNAATMGAPQRRERVFFICRRKDLNLLPLKLSFNEPPIVYKEFRSGHGARLKETSKLYKRWVKRRPSDNNGRHHEKD

SEQ ID NO: 7059 - protein, 118 aa, Bacillus licheniformis
MASYNLCVLMEENPKTLLVSVVNFDEAEEKALNLALNKISGDWDDYKLEQVLEDLQHNNFDLSLTGFSESEIDEILGELAEHEGNEGKINDSQELDLDDYEDDHFQHTCPKCGFSFNE

SEQ ID NO: 7060 - protein, 450 aa, Bacillus licheniformis
MDALRGGQDTAMGVMLDKLDKRSKLEKEASKIEPMSHTDTLKKKLEKLYDDPDEFLKVAREIGYDNLTSEQMNYVTAIEEAYEFRADPIKGTLEDGKHVLESMKGFVVGGYEFAKDTIQGTIETGKALIGQADDFIKNPKATVNSVLEYDYKAAFESMLQSIADSWDEKMVHGDSYSRGHYIAYAIGTIWGLAEAGPTVVSGSKSLGKAGKAAAQTAKKNINSVKQHFNPPKNRYTPALEGMLQRAGEAPNVKNTPLLKELLEDKKKSVLFKANSGKKPGKADSHAVHTVKYGDQYTRLNRKKVLKPNVVYETKQGYTFKTDQKGRINSVNADLQLGKAKRNLYAQSNVGKPDRLPDDDGGHLIASQFKGSGDIDNLVPMNSQVNRRGGKWYEMEQEWRNALKEVPPKKVKVKISPIYKNDSLRPDYFKVEYKIGNEKIKKIRIKNENGG

SEQ ID NO: 7061 - protein, 209 aa, Bacillus licheniformis
MKTLDVHALHHAIDQTLEQLKQQSDELSKVKKAVEGITSLDDALKGKGGDAIRAFYEECHTPFLQFYDTFIEEYSSTLKKMKSALNSLEPNHNGFISQSFLEHELEQGLNAADRTTKRLVSKTNATIAKVSHIVDLPDLNDSGFHEQNQKALKEINQTIEKLHAFDREQTSALKTAENDLETMQRYISRLEKMYTGPKIEITGYQKGSI

SEQ ID NO: 7062 - protein, 396 aa, Bacillus licheniformis
MKGMQKKEMDTYFFEYFKSIIRKEWWELVVKIRSEKVGNMLNQWYATIKLQQVHKATQMKKEIQKAIDNMEKNQDVLLYFNMIDSRYKLLIEKYNESGSILKSLKYRAEEKKTDDMLQYYFYFFSGLYQFYIKNFTKAINFYRIAENWINKIPDEAERAEFNYQIAIAYYEIHQNFFSLTHAEKALESFLALGNYENRAATTQMIIAANRLDLHQYELTESVYKKAIKMAADTRQNYVEGLGHHNLGLAYERQEKLDLARESFEIALDIFENLHSKIAIIRTSYMLARVLFKKGLFEEGTHWYQKALNLAKEINEKTYEAKLLVIHSIYKELDKTLLDKGLNMLRDKKLWSDVADLAIIAARHFKKKEYHELAAKYFDEGVVARDKIQTWTEELVS

SEQ ID NO: 7063 - protein, 43 aa, Bacillus licheniformis
MKKLLLGAVITGVFLTGILNFTTQGKAEFGTGDFKVAENAFFG

SEQ ID NO: 7064 - protein, 82 aa, Bacillus licheniformis
MNNLFLQLRDQHSLNELKVCQMDRALKQSLDGDELKIIKAKYLSPQKIKDIEIYMEMGLKKDKCYQVKRRAIYNLATALGII

SEQ ID NO: 7065 - protein, 49 aa, Bacillus licheniformis
MLTKKKPIFTIDEDFSDLTTAQKPPVNTPKKRVRDRITIEMKLFERNNN

SEQ ID NO: 7066 - protein, 173 aa, Bacillus licheniformis
MKVLIVSDSHGLEDELEMIAERHGKETDLIIHCGDSELDPSHPALSSYLTVKGNCDFYGEFKDEIVVPAGSRKLFFTHGHLYGIKQSLLNVYYRAEELGADIICFGHSHIAGSELMDGKLLINPGSIRLPRVRKEKTYAILNIDKDNATVRYYDLDGREVESLTNHVQLPAHS

SEQ ID NO: 7067 - protein, 196 aa, Bacillus licheniformis
MKEVIIATKNEGKVREFKAMLEPRGYDVKSLLDIGYTPEIEETGQTFEENAVIKAETISKETGKIVIADDSGLSVDYLGGSPGVYSARYAGEEKNDLANLKKLLKELEGVEKEDRSARFRCALAICIPGQETKTVEGSVEGYITEEPRGTNGFGYDPVFLVKDKDQTMAELSSGEKNKISHRAEALKKLSALLDQA

SEQ ID NO: 7068 - protein, 462 aa, Bacillus licheniformis
MRYDGRKNNELRPVTMDLDFITHPEGSVLITVGGTKVICNASVEDRVPPFLRGEGKGWITAEYSMLPRATNQRTIRESSKGKISGRTMEIQRLIGRALRAVVDLEKLGERTIWIDCDVIQADGGTRTASITGAFTAMALAVGRLVEKGALKEMPITDFLAATSVGIDKEKGLILDLNYQEDSAAEVDMNVVMTGEGRFVELQGTGEEATFSRSELKMRYDGRKNNELRPVTMDLDFITHPEGSVLITVGGTKVICNASVEDRVPPFLRGEGKGWITAEYSMLPRATNQRTIRESSKGKISGRTMEIQRLIGRALRAVVDLEKLGERTIWIDCDVIQADGGTRTASITGAFTAMALAVGRLVEKGALKEMPITDFLAATSVGIDKEKGLILDLNYQEDSAAEVDMNVVMTGEGRFVELQGTGEEATFSRSELDGLLELAEKGIAELLEKQKEVLGDVALSIQQ

SEQ ID NO: 7069 - protein, 369 aa, Bacillus licheniformis
MLKKGMKGIAVTVTASALLLSGCGIFQSDQASEEIDPPQDITYVKEEKEQDKTDKTKDKTEDKGSKTTSDDKAAQTGDTVMRELYLIDKNGYVTAQTLPLPKQEGTAKQALEYLVEGGPVSNILPNGFRAVLPADTTVNVDIKEDGTAIADFSNEFKNYKAEDEQKIVQAITWTLTQFNSIDKVKLRMNGHDLKEMPVNGTPISEELSREDGINLDTAGVTDITATQPVTVYYLAESDKGTYYVPVTKRTSAKEKDQVTAAIKELTEGPDNKSGLLSDFQGDVKLENKPKIEDGHVTLDFNEAIYGSADGQKKVISDEVLNSIVLTLTELPDVKSVSVTVNGKSELVNEKGEKLSKPVSRPSKVNTGSF

SEQ ID NO: 7070 - protein, 271 aa, Bacillus licheniformis
MDQPIGVIDSGVGGLTVAKEIMRQLPKEKIIYLGDTKRCPYGPRDRKEVLSYTWEMTNYLLSRHHIKMLVIACNTATAIALEEISREVAIPVIGVVQPGARTAIKVTENQRIGVIGTENTIKSGAYEEALLSLNGDLTVENLACPMFVPFVESGKFLDETADEIVRTSLHPLRDSSIDTLILGCTHYPILKEPIQRYMGERVNIISSGDETAREVSTILSYNGLLSKTAEPPEHLFLTTGERARFTKIANDWFGYEVKNVESISLQETAVK

SEQ ID NO: 7071 - protein, 147 aa, Bacillus licheniformis
MNSNASLNHIADIEKSLRHIAGIIKQKGREILTQYTITPPQFVGLQWLYEYGDMTIGELSQKMYLACSTTTDLIDRMEKNNLVERVKDPSDRRVVRIHLLSEGERIIQEVIQKRQDYLEDMLEAFSEEETAAFEKLLIKLQQEMNRK

SEQ ID NO: 7072 - protein, 74 aa, Bacillus licheniformis
MKEKEFQSKPLLTKREREVFELLVQDKTTKEIASELFISEKTVRNHISNAMQKLGVKGRSQAVVELLRMGELEL

SEQ ID NO: 7073 - protein, 232 aa, Bacillus licheniformis
MKKAIIIGASSGIGNALAKQLSAGGVEVGLAARRYELLAKLRDDLPGPSYIKKIDTADSEHSPILLKELLDEMNGADAVFICSGVGYLESEMDWSKEKETIDVNVTGFVSCSNVLMEHFIKNGRGHLVGISSIAALRGNGGAVTYAASKAFVSNYLKGLRQKVKKLGCDEIAVTEIQPGFVDTALAKGDHLFWTASPEKAAAQIISAVQKKKTHAYITKRWRLISWILKCLP

SEQ ID NO: 7074 - protein, 156 aa, Bacillus licheniformis
MKLPGYIEEPFDTWCQSFSFFDEVSVRFSETDMFGHMNNVTPFVYFEEARISYFKHLGVMDRLSDGKSAAIPVVASQQCDYFQQVMLHERLKIGVKTASVGNASLTLHYAAKNGEGGLCFTGLAVMVQIAKDTGKPVKWTDEQKAKLLGNNSFPEK

SEQ ID NO: 7075 - protein, 254 aa, Bacillus licheniformis
MSENKTIKFIITRQDTSDSNPYQEEFEIPYRPNMNVISALMEIRRNPVNAKGEKTSPIAWDMNCLEEVCGACSMVINGKPRQSCTALIDQLEQPIRLEPMKTFPVVRDLQVDRSRMFDSLKKVKAWVPIDGTYDLGPGPRMPERRRQWAYELSKCMTCGVCLEACPNVNDKTNFMGPAPLSQVRLFNTHPTGAMNKSERLEAIMGDGGLAECGNSQNCVQSCPKGIPLTTSIAALNRDTTVQAFKNFFGSDNTE

SEQ ID NO: 7076 - protein, 489 aa, Bacillus licheniformis
MGVMFNRTPEGLLDFRRFGGTQHHRTAYAGATTGQQLLYALDEQVRRFEVEGLVSKYEGWEFLGAVLDDDNTCRGIVAQNLTTMEIESFRSDAVIMATGGPGIIFGKSTNSMINTGSAASIVYQQGAYYANGEFIQIHPTAIPGDDKLRLMSESARGEGGRVWTYKDGKPWYFLEEKYPAYGNLVPRDIATREIFDVCVRQKLGINGENMVYLDLSHKDPKELDIKLGGIIEIYEKFMGDDPRKLPMKIFPAVHYSMGGLWVDYDQMTNIPGLFAAGECDYSMHGGNRLGANSLLSAIYGGMVAGPKAVEYIQGLETSAEDLSSSVFDAYVKKEEEKWADIMKMDGNENAYVLHKELGEWMTDNVTVVRYNDKLLKTDEKIQELAERYRNININDTAKWSNQGAVFTRQLHNMLQLARVITLGAYNRNESRGAHYKPDFPERNDEEWLKTTMAKHAGDFEAPKFHYEDVDVSLIAPRKRDYSKKKVAKS

SEQ ID NO: 7077 - protein, 57 aa, Bacillus licheniformis
MSNSSIIVVGGGLAGLMATIKAAEAGTNVKLFSIVPVKRSHSVCAQGRNQRSGQYKR

SEQ ID NO: 7078 - protein, 202 aa, Bacillus licheniformis
MAGNREFVYRRLHSLLGVIPVGIFLIQHLVVNHFAASGEEAFNNAAHFMENLPFRYALEIFVIFLPLIYHAVYGVYIAFTAKNNANRFGFFRNWMFVLQRITGIITLIFVSWHVWETRIAAQMGAEVNFDMMADILSSPIMLGFYIVGVLSTIFHFSNGLWSFAVTWGITVSPRSQRIATFVTMGVFVVLSYVGLRAILAFV

SEQ ID NO: 7079 - protein, 147 aa, Bacillus licheniformis
MNKYEANLAQLKELEVSAYGYELIREVLLPDMLGQDYADMMYWAGKKLARKFPLESREDLPAFFQDAGWGTLAIVHSKKQELEFELEGPLVSNRLKYQKEPCFQLEAGFIAEQIQLMNEQIAESYEQVKKRAGKVVLTVKWDLKDPA

SEQ ID NO: 7080 - protein, 409 aa, Bacillus licheniformis
MGLIVQKFGGTSVGSVEKILNVAYRVIEEKQRGHDVVVVVSAMGKSTDSLVALAKEITEQPSSREMDMLLTTGEQVTISLLTMALQNKGYDAVSYTGWQAGIETENIHGNARITNIDTAKLKERLNEGKIAVVAGFQGVTAEGEITTLGRGGSDTTAVALAAALKADKCDIYTDVPGVFTTDPRYVKTARKLAGISYDEMLELANLGAGVLHPRAVEFAKNYQVPLEVRSSTEKEAGTLIEEESSMEQNLIVRGIAFEDQITRVTVCGLASGLTTLSTIFTTLAKQNINVDIIIQSVTGTSKTSISFSVKTEDLKRTVEVLEEYKDALDYEQIETENRLAKVSIVGSGMISNPGVAAEMFAVLAEKNIQVKMVSTSEIKVSTVVNEGDMVKAVEALHDAFELSKQTAVI

SEQ ID NO: 7081 - protein, 590 aa, Bacillus licheniformis
MNKKIKEKLALLPDQPGCYLMKDRQDTVIYVGKAKILKNRVRSYFSGSHDAKTQRLVSEIEDFEYIVTSSNIEALILEMNLIKKYDPKYNVMLKDDKSYPFIKITNERHPKLVVTRKVKKDKGRYFGPYPNVQAARETKKLLDRLYPLRKCAKLPDRVCLYYHLGQCLAPCVYDVSEETNRQLTEEITRFLKGGYNEVKKELEAKMLEASENLQFERAKEFRDQIAHIESTMEKQKMMLNDMVDRDVFAYSYDKGWMCVQVFFIRQGKLIERDVSMFPLYREADEEFLTFIGQFYSKNNHFLPKEILVPDSVDKDMIEELLDVNVRQPKRGAKKDLLLLAHKNAKLALKEKFSLIERDEERTIGAIEKLGKALDIYTPYRIEAFDNSNIQGTDPVSAMVVFLDGKPHKKEYRKYKIKTVEGPDDYGSMREVIRRRYTRVLKENLPLPDLILIDGGKGQVSAALDVLENELGLDVPVAGLVKDDKHRTSNLLIGDPLEIVQLERNSQEFYLLQRIQDEVHRFAISFHRQLRGKSAFQSVLDGIPGVGEQRKKLLLKHFGSVKKMKEASAEDIRKLGIPLKTAQLIEEALKK

SEQ ID NO: 7082 - protein, 104 aa, Bacillus licheniformis
MAIVKATDQTFSSETSEGVVLADFWAPWCGPCKMIAPVLEELDQEMGDKLKIVKIDVDENQETAGKYGVMSIPTLLVLKDGEVVETSVGFKPKEALEELVNKHL

SEQ ID NO: 7083 - protein, 325 aa, Bacillus licheniformis
MSKKVIVLGEFRDGSLRNVTFEAIAAGKTVAEGGEVIGVLFGESVSSHAAELIHYGADRVLTAENPLLKNYTSDGYVQALLPIIERENPDVIIFGHTSMGKDLSPKLSARMGTGLISDAVDVEVAGGNIVFTRPIYSGKAFERIISEDETIFATIRPNNIAPLDKDETRTGAVESIEADIRDIRTVIKDIVKKTSEGVDLSEAKIIVAGGRGVKSEEGFKPLQELADVLGGAVGASRGACDADYCDYSLQIGQTGKVVTPDLYIACGISGAIQHLAGMSNSKIIVAINKDPEADIFKIADYGIVGDLFEIVPLLTEEFKKLSVST

SEQ ID NO: 7084 - protein, 257 aa, Bacillus licheniformis
MNIYVLMKRTFDTEEKIQIEQGEINTDGAEFIINPYDEYAIEEALQLKEKHGGEITVVTVGEEEAEKELRTALAMGCDKAVLINIEDDVEEADQYTASAILYNYLKDREYDIILGGNVAIDGGSGQVAPRLAELLGIPCITTITKLTVNGGDVEAERDAEGDLEVIQTSLPIVATAQQGLNEPRYPSLPGIMKAKKKPLEELELDDLDIDEEDVAAKTKTIERFLPPKKEAGKILEGEPEQQAAELVSLLRSEAKVV

SEQ ID NO: 7085 - protein, 258 aa, Bacillus licheniformis
MAALSYAVDGHVATITIQHPPANALSTQVLEDLSACLDELSERQDVRSVVIHGEGRFFSAGADIKEFTSLMDGSDYANLADKGQQIFEKVESFPKPVIAAIHGAALGGGLELAMACHIRIAEESAKLGLPELNLGIIPGFAGTQRLPKYVGTAKALEMIGTSEPISGKEAFEYGLVTILAANEEEVLQKAKELAQKFAEKSPQTMAYVIELLNSSKVYSYEGGLKLEGKYFGEVFQSEDAKEGIQAFLEKRKPHFKGK

SEQ ID NO: 7086 - protein, 192 aa, Bacillus licheniformis
MQIIDAAVIVIAENGYHQAQVSKIAKQAGVADGTIYLYFKNKEDILISLFKEKMGQFIEQMSEEMTAKNSATEKLSLFIKKHFELLSSDRHLAIVTQLELRQSNLELRLKINEILKGYLTILEDIITEGKEAGEFKSTLDVRLAKQMIFGTVDETVTTWVMNDQKYDLPNLADSIHELLIHGFSSQKTKEEE

SEQ ID NO: 7087 - protein, 559 aa, Bacillus licheniformis
MPTEKPWLRHYPEQIPHELQFEDQTLHSILQQSAQQFSEKTAIHFLGKKRSYREVYEDALKMADYLLSLGIQKGDRVSIMLPNCPQAVIAYYGVLFSGGIVVQTNPLYTERELEHLLHDSGATIIITLDMLYPAAYKMKALTSIRHIIATSIKDYLPFPKNLLYPIVQKKENQMSVEINENETTHLFRTIMKRPVPSGPPGIEIDPAHDIAVLQYTGGTTGTPKGVMLSHRNILANMEMCAAWFYQLNKGEEKVLGIVPFFHVYGMTAVLNFTIRQGYEMILLPRFDARAALKTIDKEKPTIFPGAPTIYIALLNHPDLHQYDLSSIKSCLSGSAALPVEVKQQFEKVTGGRLVEGYGMSETSPVTHANFIWDLNKAGSIGCPWPGTDAAIYSEETGGFLGPYEHGEIAVKGPQVMKGYWNNDEETAQSLRDGWFFTGDIGYMDKDGFFYIVDRKKDVIIAGGYNIYPREIEEVLYEHEAVQEAVVAGIPDEYRGETVKAFVVLKDHVTITEKELDEYARSRLAPYKVPKVYEFRDELPKTAVGKILRRALVQEEKTGV

SEQ ID NO: 7088 - protein, 134 aa, Bacillus licheniformis
MKEFWENNLVEIAAYYSVSVLCLVIFLSVFELVTTYKNWEEIQKGNMAVAMATGGKILGIANVLQKSISQHNSLLQMMGWGLFGFILLLIGYFIFEFLTPRFKIDKEIENDNRAVGFISFVISVGLSFVVASGI

SEQ ID NO: 7089 - protein, 785 aa, Bacillus licheniformis
MQQKALSALEFHKVKEQLTEHAASSLGKEMLLELKPSRSLEEVKKLQEEVDEAGTVLRLKGSAPFGGLTDIRKALRRAEIGSILSPAELTEISGLLYAAKQMKHFLEGLFEDGVEIPYLHQYAEKLIPLSELERDINSCIDDHGEVLDHASETLRGIRTQLRTLESRIRDRLESMLRSSSAQKMLSDTIITIRNDRFVIPVKQEYRSSYGGIVHDQSSSGATLFIEPQAIVDMNNALRQAKVNEKQEIERILRVLTEKTAEHTNELFHDVKVLQTLDFIFAKAKYAKATKAVKPAVNADGYVRLIQARHPLLPLDEVVPNDIELGGEYTTIVITGPNTGGKTVTLKTLGLLTMMAQSGLHVPAEEGSETAVFDQVFADIGDEQSIEQSLSTFSSHMVNIVDILKDMTENSLVLFDELGAGTDPQEGAALAISILDEVCQTGARVIATTHYPELKAYGYNRENVINASVEFDIDTLSPTYKLLIGVPGRSNAFEISKRLGLPDYLIGRAKAEMTAEHNEVDTMIASLEDSKKRAEAELKETEAIRAEAEALHRDLQQQISEWQEKKDKLYEEAEQKAAEKVKAAMKEADDIIQSLRMIKEDHKAFKDHELIEAKKRLEEAVPSFEKAKKPAQKKTDKRELKPGDEVKVLTFGQKGTLLEKTGAAEWNVQIGILKMKVKEKDLEFLKSAPEPEKQKTIAAVKGKDYHVSLELDLRGERFENALHRVEKYLDDAVLAGYPRVSIIHGKGTGALRKGVQDLLKSHRNVKNSRFGEAGEGGSGVTIVELK

SEQ ID NO: 7090 - protein, 574 aa, Bacillus licheniformis
MNNMHKKDIIKLLETIAIYMELKGDNPFKISAFRKAAAALEQDDRSLSEIDDMTSLSGIGKGTYAVIKEYMDTGASGTLERLKEEVPEGLVPLLKLPGLGGKKIAKLYQELGVCDAASLKEACEQQKVQGLAGFGKKTEEKILQALGEAGKRPERYPIAVALAVADIIEEQLEGLPGLIKFSRAGSLRRAKETVKDLDYIMAVTDPELVREGLLKLSNIKEVIAAGDTKVSLTFAFEYEISADFRLVTEEQFPTTLHHFTGSKDHNIKMRQLAKEKGERISEYGVETVETGEIKTFSSEKEFFAHFGLPFIPPELRETGREVEDYSVDIGLVSAEDIQGDLHMHSAWSDGAFSIREMAEACMAKGYRYMAITDHSQYLKVAGGLTPERLRMQAKEIDELNKEFTDFHIFKGVEMDILPDGTLDYDDELLAEMDLVIASIHSSFSQPQHVIMKRLETALLNQHVDIIAHPTGRLIGRRAGYEVDIDQLIELAKKTNTALELNANPARLDLRMEHLIKANAAGVTLVINTDAHNTAMLDDMKTGVTAARKGWTPKANVLNTRSFEEVQAFLSRHRS

SEQ ID NO: 7091 - protein, 178 aa, Bacillus licheniformis
MLDIIIIILLLSGLFIGLKRGFIRQFIRLVTFIAAIAVAATYYGDLAPKLGWIPSPDFTGGQAALAFVNGSLEGAYYNMIAFLILFILTIILLRVAASFLDAVASIPVLKQINQILGAVLGFAEIYLSVFVVLSIGTLLPIDVLQNMMAGSVMADLIIHKTPFLSNMLNNLLHQYGSL

SEQ ID NO: 7092 - protein, 85 aa, Bacillus licheniformis
MSDGQKTRTTVDIYGQQFTIVGDESKSHMRHVASIVDDKMREINEKNPYLDINKLAVLTAVNVVHDYLKLKEELERLKGQIKEKD

SEQ ID NO: 7093 - protein, 313 aa, Bacillus licheniformis
MSHSVLKVPPSVIERMQSHYGPDITSLSVQGAVFQAKPQGCTITAYRSGKVLFQGKNAEKEAERWTADAETPAPKKPASKKSIPSVYQPPEGIGSMSVIGSDEVGTGDYFGPITVACVYADKAKLPLLKELGVKDSKNLKDPQIVQIARDLIKTVPYSLLVLRNEKYNEMQEKGMSQGKMKALLHNQAIGNLLKKLDGTRPEAILIDQFAEPAVYFKHLAGKTAVKERTYFSTKAEGIHLSVAAASIIARYSFLMEMDKLSKQAGITLPKGAGPLVDEAGAKLIKKHGEDALRVFTKLHFANTQKAKRIASKR

SEQ ID NO: 7094 - protein, 36 aa, Bacillus licheniformis
MDEEIRFIWHSFNYFSSHNINVFYVKYKGFDLQDMT

SEQ ID NO: 7095 - protein, 267 aa, Bacillus licheniformis
MSKIKWIITLTICTALAFSLFIFFNKANFTEASENKETGLFFARNYISHMMENETMSFNIFGLQKANAGVPLSGETVTSLAFDNNHIQISDYKVETGIRHKGYTLVNIIVDVRVSSDKPEKADQLLISFNGRDREAFQIGKITLQNHHNVRSGDLSPAGQYTAGYPKPSLDVRLKNNLAKDISLEKITDLNGVMAYTFDKGTAIQAKQSKHIVVPSFHMTGEYDFYTVTPVLRYTAAGKRNQYSMPGVLYGALDSDEEKIERMLKRQ

SEQ ID NO: 7096 - protein, 46 aa, Bacillus licheniformis
MTQFSRILEKGIYSPHIKILAKEEVTKVHDQVLKALEDTYQAVLRG

SEQ ID NO: 7097 - protein, 480 aa, Bacillus licheniformis
MNNKYLIYSKILLTNDIRKFNTKSKWLALFVLILSFVVFPLIIGSFAGYIIKNLVIIHLSFFLFILTVNIDKSIFRVMFSSDKKQMAILGIKLDQFILGKDISKFYSSFLSLISFYVGSSIVYYLIHQSLEEVFAIAVIGLLSAILGYLLRLHFIRLLVLPKFINVSSIIGFFTNGILILWIFFILKYNLLFLNINNMRIFSISIPIMVSLTILLIIVWYKSLRNLSIFNDHLNSKTDTNLKKSRESRSLLYYELILLYRNPPVRWSVLLFILSLSAGLLTIILYGFNTDRFADTGISNEFSFMFSVLFPLVFISIMIQSLVSFDIDGLIIPLNQHKPNFIKNKIKAKTKISVLAHVLFVLIYAAISNFYIKPDHFIALSIILLMIAVTLGLSCLTSTILFPYFKWDYIYQVPSTLSKIFLNLVFGLLIGLAIVSTYNKVLYVVIFITLLCIITLLHSINKQIWKSTINKNYISIKSLFE

SEQ ID NO: 7098 - protein, 264 aa, Bacillus licheniformis
MYHNATALHKQANMEINNQQKLHINKIFIRVSDYMLKLQNISKEYPQSNFSMKNLEFACGRNQIIGLLGKNGAGKTTLLEIIAGLIPPDSGEVVVDGHLTNYLEKIGYLEDDPKLFENLTCYELIKYQSLLIEKPLSQEQIIETLDMFSLKEQKDQMASSLSRGMRQRMSFILSTLHQPDVILLDEPFTGLDPKNMADMKKILINIRNQNRIIILSTHILQFAADLCDEILFINNGNIIHTEKKLAGETFNEASLEKKFLEYLC

SEQ ID NO: 7099 - protein, 182 aa, Bacillus licheniformis
MKKTKFNLICICLLSGAAALCVSILKMNEIDASLHELNEDEYGNLITISKWIGITIAVIGEAIKPLLELLFFTLIIWLAIMIFGAKDSFKNIFSKGVLSYYFNLVGSVLVIVFYLFGLKDAESLFSIPFLRNLNIFSLISLFFWCYLCLEKKENSLKIKYSFSFFILFLFSIAISIFSDILA

SEQ ID NO: 7100 - protein, 804 aa, Bacillus licheniformis
MFVSYKWLQEYVNLDGMTPEILAEKITRSGIEVEGIEYKGEGIKGVVIGHVLEREQHPNADKLNKCLVDIGEEEPVQIICGAPNVDKGQKVAVATVGAVLPGNFKIKKAKLRGEASNGMICSLQELGIQGKLVPKEYAEGIFVFPGDAETGADALQSLALDDAVLELGLTPNRADAMNMLGVAYEVAAILGREVKLPETAYQAGAEKAADYISVKIEDPEANPLYAAKIIKDVKIGPSPLWMQTKLINAGIRPHNNVVDVTNFVLLEYGQPLHAFDYDRFGSKEVVIRKAYENETITTLDEQERTLTTEHLVITNGSSPQAVAGVMGGAESEVREDTATVLLEAAYFNGQTVRKASKDLGLRSESSVRFEKGIDPARVRLAAERAADLISRYAGGTVLEGTVEENHLDIKENVIRLSVDKVTKVLGMSISKEEMVNIFERLGFAVEDAERELVVTVPSRRGDIAIEEDLIEEVARLYGYDNIPSTLPEVTGFAGGLTPYQDKRRKVRRFLEGAGLSQAITYSLTNDKKATAYALEKSFKTILSLPMSEERSVLRHSLLPNLLDSVAYNLARQADSAAFYEIGSVFLKAEEHTKPVEKEHVAGAVTGLWHKNLWQGEKKPVDFFVVKGIVEGLLEKLGITEGIEFAQSERKELHPGRTANILHNGSLVGFIGQLHPSVEKELDLSDTYVFELDLHELLRLDVPEITYTPIPKYPSVTRDIALVVDKQTTAGQLEDVIKTAGGKWLKEVHVFDVYEGEHMEEGKKSVAFSLQYLNPEQTLTEEEVTKVHDQVLKALEDKYQAVLRG

SEQ ID NO: 7101 - protein, 344 aa, Bacillus licheniformis
MQEELKRLEKEAVEKVEAAGSLKEVNDVRVAYLGKKGPITEVLRGMGKLSAEERPKMGALANEVREKIAAAIAEKNARLEEEEVKRKLKEQTIDVTLPGSPVKTGARHPLTIVIEEIEDLFISMGYSVEEGPEVETDYYNFEALNLPKEHPARDMQDSFYITEDTLMRTQTSPVQTRTMEKHKGKGPVKIICPGKVYRRDNDDATHSHQFMQIEGLCVDRDISMSDLKGTLETVAKKMFGEEREIRLRPSFFPFTEPSVEVDVSCFKCGGKGCSVCKQTGWIEILGAGMVHPNVLEMAGFDSKQYQGFAFGMGVERIAMLKYGIDDIRHFYTNDVRFLSQFKQA

SEQ ID NO: 7102 - protein, 248 aa, Bacillus licheniformis
MKRIESAKNQKVKDWKKLHAKKERTKTNTFLIEGEHLVEEALKTPGVVKEIMVADEADFPAMIDESVARYVLSADAFSAIAETETPQAVAAVCRMPESGPFQYEKLLLADAVQDPGNLGTIIRTADAAGIDAVVIGQGTVDPYNAKTLRSAQGSHFHIPILKRELSELIEELKGKSVPVYGTALQGAVPFREAEPSQSFALLIGNEGSGVDPALLAQTDQNLYVPIYGKAESLNVAAAAAVLLYHLRG

SEQ ID NO: 7103 - protein, 70 aa, Bacillus licheniformis
MDLNLRHAVIANVSGNSQEELEHTIVDAIQSGEEKMLPGLGVLFEVIWQHATESDKTEMLETLEQGLKAK

SEQ ID NO: 7104 - protein, 598 aa, Bacillus licheniformis
MNAITIVIASICILAIAYRLYGTFMMVKVLKVDDDKPTPAHLQKDGKDYVPTNKWVSFGHHFAAIAAAGPLVGPILAAQFGYLPGLLWLLIGAVIGGAVHDIVVLFASMRRKGKSLSEVAKEELGPVAGFCTGLAMLFIITITMAGLSMVVLHALERNPWGTFAVAITIPIAMGVGLFYKKTGNLKLASTGGFILLMAGVFIGPSIAETPLGDALTLDTKTLAVALPVYAFFAAALPVWLLLAPRDYLSSFMKIGVFIALIAGVFVVNPAIPFPAFTEFTGGGGPVSPGPVWPFISITIACGAISGFHAFVGSGTTPKMLDKWSDMKFVGFGAMLVECLVGIMALIAATALQPGDYFAINSSPEVFRTLGMNVVHLPELSREIGLDLEGRTGGAVTLAVGMAYIFTDIPFFSHLASYFFQFVIMFEAVFILTAIDAGTRVARYLIQDFFGEVYKPLKKTDWLPGSVAASALACFMWGYLLYSGDISSIWALFGVSNQLMASVGLIIGATVILKIADKRRYMLTCLIPLAYLYVTVNYAGYWMIKNVYFNAEAAGFSVLNGILSIIMLVLGLVIMAAAIKKWTEIWRDPALRMEPSIPG

SEQ ID NO: 7105 - protein, 502 aa, Bacillus licheniformis
MTVHKAKMTIDKEYKVAEIDKRIYGSFIEHLGRAVYEGIYEPDHPEADESGFRKDVIKLVRELKVPFIRYPGGNFVSGYNWEDGVGPVEQRPTRLDLAWATTEPNLIGTNEFMDWAKLVGAEVNMAVNLGTRGIDAARNLVEYCNHPSGSYYSDLRKSHGYKEPHKIKTWCLGNEMDGPWQIGHKTAAEYGRLAAEAAKVMKWTDPSIELVACGSSGSGMPTFIDWETTVLDHTYEHVEYISLHSYYGNRDNDLPNYLARSLDMDHFIKTVISVCDYMKAKKKSKKTIHLSYDEWNVWYHSNEKDKEAERWAKAPHLLEDIYNFEDALLVGCMLITMLKHADRVKIACLAQLVNVIAPIMTDKGGEAWRQTIFYPFMHASVYGRGTVLQTAVSSPKYDAKDFTDVPYLESVSVFNEEAEELTVFAVNRATDAGLEMEADMRSFEGYSVSEHIVLEHEDHKATNEKDRNNVVPHSGGDAKVCDGRLTAHLPKLSWNVIRMKKQ

SEQ ID NO: 7106 - protein, 280 aa, Bacillus licheniformis
MRPAGGLNIAKVALFLLFAILSFLFVFPLFCLVLGSLKPSSELLRFGLNLKLSPEILSLDNYTYLFNGGSIYFQWFSNSLILVVISTVLTLLFSSMVGYGLAVYDFKGKNLLFVAVLLIMMVPIEILMLPLFKMTVSLHIVDTYAGVILPFIVSPVAVFFFRQYALGLPRDLLDSARMDGCTEFGIYFRIMAPLMKPAFGAMIILQSLNSWNNFLWPLIVLRSKEMFTLPIGLSALLSPYGNNYDMLISGSVLAILPVILIFLFFQKYFISGLTAGGIKG

SEQ ID NO: 7107 - protein, 314 aa, Bacillus licheniformis
MKTVKTDTVHSFPPVSRKRKIRRLLYSAKAAPYIFTAPFVLSFCIFFLYPLISVVIMSFQSILPGEVRFIGTENYKALNNPTFYTALFNTVKYTFWTLLILIPVPLILAVFLDSKLVKFKNVFKSALFIPALTSTIVAGIIFRLIFGEMDTSLANSILAKLGGSPYNWLNNEHTGMFLMVMLASWRWMGINVLYFLAGLQNVPKELYEAAEIDGAGTFKKFYHITLPFLKPVSVYVLTISIIGGFRMFEESYVLWQNNSPGNIGLTMVGYIYQQGLAYNNMGYGSALGIVLLIIIFICSLISLKLSGSFKKEGY

SEQ ID NO: 7108 - protein, 434 aa, Bacillus licheniformis
MKRFLSSIFMVTVAVCLLLSGCKASPASDQADGTELTFWTFNGLHEQFYAEMVKEWNKKYPERKIKLNTVVYPYGQMHDNLSISLLAGKGVPDIADVELGRYSNFLKGSDIPLTDLTPLVEDERDKFVEARLTLYSKNGKLYGLDTHVGTTVMYYNMEMMNKAGVDPDDIKTWEDYREAGKKVVKALGKPMTTIETTDPNSFLPLVSQQGSGYFDEQGRLTLNNETNVKTLEFLKTLIEKDKIAVTTPGGNHHSEEYYGFMNQGGAASVLMPIWYMGRFLDYMPDLKGKIAIRPLPAWEEGGDRSAGMGGTATVIPKQAKQVDLAKDFLKFAKASKEGNIKLWTVLGFDPLRWDVWDSDELKKPNQYTEYFQNGQHIFSVLLDIKDEINPLYLTEDYAKTSDLVNRNILYEALKTKSKTPKEALDKAAAEVKGQ

SEQ ID NO: 7109 - protein, 401 aa, Bacillus licheniformis
MNDLISYVKKTLGACECGTVHHPLTVEKIAIGDNAVEQELPAFVKSASYKKAAVIYDETTGRLAGKRIASLLEETAETVPVLLEANEAGDVTADEQTLVSALIGVPIDADVLIAAGAGTIHDIVRFCAYQRGIPFISVPTAPSVDGFTSAGAPLILKGKKQTVQTTAPIALFADLELLCQAPQNMVAAGFGDMLGKVTSLADWEISRLLAGEPYCPAASRLTREALDQCLDRKDDIAAKMRDGIEKLMESLILSGLVMLVLDHSRPASGGEHHLSHYLEMKALENNKRQVLHGAKVGCSAIMLTDIYRSLIGASLGDQHAEQAIRSVYEKLPDGKKMAEWMRRIGGPVSFKELDVEEELVREALAYAHQLRDRYTGLKIINQYGLLPGLLGKGPGVKGVKM

SEQ ID NO: 7110 - protein, 228 aa, Bacillus licheniformis
MLESLKEQVLKANLQLEEYRLVTFTWGNVSGIDRENKLVVIKPSGVKYSDLKAEDLVVLNMDGEIVEGDLKPSSDTPTHLYLYRQFQSIGGIVHTHSPWATSWAQSGKDIPSLGTTHADYYHGDIPCTREMDPDEIRSQYELNTGKVIVETFRHLDPLAVPAVLVNNHGPFCWGKDALTAVHNAVVLEEVAKMAYRSLMLNPSLKRIKSALQDKHYFRKHGADAYYGQ

SEQ ID NO: 7111 - protein, 552 aa, Bacillus licheniformis
MSGRAVLVDVRTGEEIATAVKEYTHGVIDRELPVSKRKLPRDWALQHPADYIEVLEETIPSLLKQSKADPKEIIGIGIDFTACTILPVDENGTPLCMREEYASEPHSYVKLWKHHAAQEQANRLNQIAEERNEPFLQTYGGKISSEWLVPKVMQIAEEAPDIYDAAAEIMEAADWIVYMLCGTRKRNNCTAGYKAIWNNKSGYPSDDFFASLHPKLKNIVREKLTEDIYSVGEKAGGLTEEMAGKTGLLAGTAVAVANVDAHVSVPAVGITEPGKMLMIMGTSTCHMLLGEDVRMVPGMCGVVEDGILPGYVGYEAGQSCVGDHFHWLIQHFVPEAYLKEAEAEGISIYELLSQKAGSLQIGESGLLALDWWNGNRSTLVDADLTGMLLGMTLATKPEEIYRALVEATAYGTRIIIETFRQSGVPIEELYAAGGIAEKNPFIMQVYADVTNMEIKISGSPQAPALGSAIFGALAAGSMNGGYDHIEEAVAHMGKIKDKTYKPIPENVSLYDQLYAEYKELYTYFGKQNNVMKRLKKLKNIQSLSSDTGKAMA

SEQ ID NO: 7112 - protein, 493 aa, Bacillus licheniformis
MIQAKTHVFWFVTGSQHLYGEEAVQEVEEHSKMICNGLNDGDLRFQVEYKAVATSLDGVRKLFEEANRDEECAGIITWMHTFSPAKMWIPGLSELNKPLLHFHTQFNRDIPWDKIDMDFMNINQSAHGDREYGFIGARLGIPRKVIAGYWEDREVKRSIDKWMSAAVAYIESRHIKVARFGDNMRNVAVTEGDKIEAQIQLGWSVDGYGIGDLVTEINAVSEQSLSELISEYEELYEWPEGEAARESVKEQARIELGLKRFLSSGGYTAFTTTFEDLHGMKQLPGLAVQRLMAEGYGFGGEGDWKTAALVRMMKMMAGGKETSFMEDYTYHFEPGNEMILGSHMLEVCPSIAEHKPRIEVHPLSMGAKDDPARLVFDGIAGPAVNVSLIDLGGRFRLVINKVEAVKVPHDMPNLPVARVLWKPQPSLRTSAEAWILAGGAHHTCLSYQLTAEQMLDWAEMSGIEAVLINRDTTILNLRNELKWSEAAYRLRKF

SEQ ID NO: 7113 - protein, 320 aa, Bacillus licheniformis
MKNVLRKMSLAALIFGLLLSFSMPESGKAAFWDTKGDNFIHDPSIIKEGNTWYTFGTGLGTGLRVIKSTDGRNWSAAPSIFPTPLSWWKMYVPNHEPHQWAPDISYYNGRYWLYYSVSSFGSNTSAIGLASTDRISSGQWRDDGLVIRSTSGDQFNAIDPDLVIDKDGNPWLSFGSFWSGIKLTRLDKNTMKPTGSLYSIASRPNNGGAVEAPNITYKDGYYYLFVSFDSCCKGVDSTYKIAYGRSTSITGPYYDKSGKNMMNGGGTILDSGNDRWKGPGHQDVLNNSILVRHAYDALDNGVSKLLINDLYWDSQGWPTY

SEQ ID NO: 7114 - protein, 361 aa, Bacillus licheniformis
MAKLDETLMMLKELTDAKGIPANEKEPRQVMKSYIEPFADEVTTDRLGSLIAKKTGQADGPKIMIAGHLDEVGFMVTRIDDRGYLRFQTVGGWWSQVMLAQRVTVVTKKGDITGIIGSKPPHVLSQEARKKSVDIKDMFIDIGASSREEAMEWGVLPGDQVVPYFEFTVMNNEKMLLAKAWDNRIGCAIAIDVLKNLKGADHPNVVYGVGTVQEEVGLRGAKTAAHTIKPDIAFGVDVGIAGDTPGITEKESASKMGKGPQIILYDASMVSHKGLRDFVTNVADEAGIPYQFDALSGGGTDSGSIHLTANGVPALSITIATRYIHTHAAMLHRDDYEHAVKLITEVIKRLDKETVQNITFD

SEQ ID NO: 7115 - protein, 133 aa, Bacillus licheniformis
MIVIILRLALLALLVYVVYRAVQFLGSPDRRLKSAQAKKHFYVLDEQKNTRKNLKLTFKGVLFEGEKHIPSKDHPLFIHTIFVWTEAPEEKLSSFTEEDFAELEENIKEHYPDCKIDWDSNIQKWKNKKAEEQ

SEQ ID NO: 7116 - protein, 87 aa, Bacillus licheniformis
MTLIWIYMILINGYGFFLMKADKQKAVRGKWRVSERRIWLVAAAFGSAGVWFGMMRFRHKTKHLSFRLGIPFLLGVQAVLTGFYMMN

SEQ ID NO: 7117 - protein, 119 aa, Bacillus licheniformis
MPRVKGGTVTRKRRKKVLKLAKGYFGSKHTLYKVANQQVMKSGNYAFRDRRQKKRDFRKLWITRINAAARMNGLSYSRLMHGLKLSGIEVNRKMLADLAVNDLNAFNQLADAAKAQLNK

SEQ ID NO: 7118 - protein, 66 aa, Bacillus licheniformis
MPKMKTHRGSAKRFKKTGSGKLKRSHAYTSHLFANKSQKQKRKLRKSAVVSAGDFKRIKQQLANIK

SEQ ID NO: 7119 - protein, 186 aa, Bacillus licheniformis
MSCEINSKILWRWLIISKDQLVNEGIRAREVRLIGQNGDQLGIKSRQEALEIAGRANLDLVLVAANAKPPVCRIMDYGKYRFEQQKKEKEARKNQKIINLKEVRLSPGIEEHDFNTKLRNAIKFLQKGDKVKASIRFKGRAITHKEIGQRVLDRFSEACAEVATVETKPKMDGRSMFLVLAPKTEK

SEQ ID NO: 7120 - protein, 227 aa, Bacillus licheniformis
MTPYFGIVVSLAAFGTGTFLFKKSNGFFLFTPLFVAMILGIAFLKIGGFSYEDYKSGGDIIKFFLEPATIAFAIPLYKQADKLKKYWLQILGAIIAGSVCSVAVVYLIANALHLDGAVMKSMLPQAATTAIALPLSKGIGGIQDITAFAVIFNAVIVYALGALFLKIFKVQHPIAKGLALGTSGHALGVAVGIEMGEVEAAMASIAVVVVGVVTVFVVPLCVQMIGG

SEQ ID NO: 7121 - protein, 137 aa, Bacillus licheniformis
MKGKKEYGFLTQAFIFAVMMFISNGIAAVLPIPIPPSVIGLVLLFALLCTKVLKLEQVESLGTALTSLIGFLFVPSGISVMNSLGVMEKYGLPIVLVIFLATVILLAATGLFSQFILSVGKKDRQDTRVEPAKKTAS

SEQ ID NO: 7122 - protein, 518 aa, Bacillus licheniformis
MDHSRGGRFVPSGEFASLARRGLMPEDASIAAGAPRFADYPFKLGVASGDPHPNGFVIWTRLAPDPLAEDGLGGMPDKAVPVQWEVAEDEHFHKVVKRGTSSALAELAHSVHVEVHGLKPGSYYWYRFKAGREISRTGRTKTAPAPHADIKGMSFALASCQAWYHGYFTAYRHMAEDHPDVVFFLGDYIYEYAINAKNLFRDVTLSAAHNAKTVTLSQYRLRYSLFKTDPDLQAIHALAPWVVTMDDHEVENNYAGIHSQYNTFPDDFLRQRAAAYQAFYENIPIRSTSIPKGPDMLMYRRFRYGNLAEFNVLDTRQYRNNFPANEAERLEPSRSILGFDQERWLFHGLSRSDTIWNFLVQQVVLAQIDRDTGPGVEYSTDQWDGFPACRDRLFSAYKAYGIQNPVVLTGDIHRHAAADLKADFDDAGSATIGTELITTSISSDADGSETDSLAPIWLGNPHVKLYNAQRGYVRCRLTPRQLEADFQVLPYITRPGAPASTYAKFAVEAGRPGLQRMF

SEQ ID NO: 7123 - protein, 240 aa, Bacillus licheniformis
MLKVLIVDDEMFARDELRYLLEQTEEVDAIDEAEHIEEAFDKMADRKPDILFLDIDLSGENGFDIAQRLKKMSAPPAVVFATAYDEYALKAFEVDAIDYLTKPFDEERIRQTIHKYKRMRPGKQEERQLAGHHRLALSIDESIVVLDPDEIVYAGLEGGHVTVKTFDQAYTVHDTLVVLEQKLSQTALIRVHRSFLANMDHIKQVKPWFNSTYNLLMKDGSTIPVSRTYAKELKKRLHMV

SEQ ID NO: 7124 - protein, 594 aa, Bacillus licheniformis
MVQLMIMMLERVGIIVILGFMLAHMKVFRQHLQHPEGYKGKGVLIFIFSLFSIISNYTGIEIREREILNNDWIFAIDPSSSIANTRILGVEIGGLIGGPFVGAGVGLLSGIHRFSLGGTTALSCAVSSLLAGVIAGYIGSFFRNRHQMVTPRVAALAGICMEGLQMLMILVLAKPQAEALALVQMIGIPMMIVNGTGSFIFLSIIQSIIRKEEQARAVQTHKVFSIADQTLPFFRRGLNEDSCKSAALIIHRMTGTDAVSITDRENILAHVGDGADHHIPSKNLITGLSKKVIQTGKVMKVKSRDEIECAHRSCPLQAAIVLPLFSNRETIGTLKLYFKHPSGLNRVTEELAEGLAMLFSTQLELGEAELQSKLLKDAEIKALQAQVNPHFLFNAIHTISALCRTDPEKTRKLLLQLSVYFRSNLQGARQLMIPLSKELNHLEAYLSLEQARFPGKYHIDFHIEDGLENMEIPPFILQLLVENALRHAFPRKQKVCTVKVSAVRERDGVLMKVSDNGRGINPEMLGQLGQAPAPSKEGNGTALYNVNQRLTGLFGHQAALQIASELDKGTEISFKIPFQTEREGNRDAQGINRG

SEQ ID NO: 7125 - protein, 75 aa, Bacillus licheniformis
MKKRWVFWWICNILWTAVFVIGAAVVWLRDVDGAGVAQTPELKLIAFIVLLIAFIFPFIIQVVWLIVNFKVGSSK

SEQ ID NO: 7126 - protein, 276 aa, Bacillus licheniformis
MAEEKMMKAVFFDLDDTLLWDEKSVSTAFSKTCLKAEEKYGIHAEEFEAAVREAARKLYMSYETYPYTVMIGINPFEGLWSNFSEPISEGFQKLNKIVPEYRRNAWTNGLKAFGIDDPAFGEELGEYFAAVRRKSPFVYEETFAVLDELKGKVELLLLTNGDPSLQKEKLAGVPELAPYFNEIVISGEFGKGKPDPSIFEHCLTLLGMTKDDAVMVGDNLNTDILGASRAGIQTVWVNRKGKKNETDVAPDHEISHLSELFDILRGQAADKLSKKA

SEQ ID NO: 7127 - protein, 643 aa, Bacillus licheniformis
MSDMVKIKFPDGAVKEFAKATTTEDIAASISPGLKKKAIAGKLNGKEIDLRAPILEDGAIEIITEGSEEALEIMRHSTAHLMAQAIKRLYKNVKLGVGPVIENGFYYDVDLEEALTPEDLPKIEKEMKKIVGENLPIVRKEVSREEARALFAEIGDDLKLELLDAIPEGETVSIYEQGEFFDLCRGVHVPSTGKIKEFKLLSLAGAYWRGDSNNKMLQRIYGTAFFKKAELEEHLRLLEEAKERDHRKLGKELKLFANSQKVGQGLPLWLPKGATIRRVIERYIVDKELALGYEHVYTPVLGSKDLYETSGHWDHYQDGMFPPMEMDNETLVLRPMNCPHHMMIYKNDIHSYRELPIRIAELGTMHRYEMSGALSGLQRVRGMTLNDAHIFVRPDQIKDEFIRTVRLIQDVYEDFGLEEYSFRLSYRDPEDTEKYYDDDEMWNKAQSMLKEAMDEIGHDYYEAEGEAAFYGPKLDVQVKTAIGKEETLSTVQLDFLLPEKFDLTYVGEDGKPHRPVVIHRGVVSTMERFVAFLIEEHKGALPTWLAPVQFQVIPVSPSVHLDYAKKVQERLQREGLRVEVDTRDEKIGYKIREAQMQKIPYMLVVGDQEVENEAVNVRKYGEQKSETVAIADFIKKAVAEAKK

SEQ ID NO: 7128 - protein, 280 aa, Bacillus licheniformis
MLEITFEDDYDTAAFLHLLRNADANRHIRIHEAPGKIGIEKTHSSVSIQAYIEPVLTRFFTECKEDEYMLSVIEGDYYFLDRDEQQQILQLAHSIMEGELEGLPLNKDDTPREHYIIQELQAICLEENVFSIRSFMTFRLAKYYERLRSYVEAAIDEYKMEQEYQTFIQSLRDYVMSKEPMLDHVHIVHDGYFVLWELKYISEREQKKYIDRRFVREHPMYIDSHLLAPLVSIAPEKIDLYTEDREHAMVQTIQNIFQERVRILPLGAFHPRENILEEHS

SEQ ID NO: 7129 - protein, 210 aa, Bacillus licheniformis
MRKRTLAKWTVIAVIAAAGLWLNAKYLNLSPAHIREGVLSFGIFAPLIYIGLLMIRPFLLLPASVFAVSGGLAFGPLFGSLYSFIGAAGGAFLSFALAYRLGGYFQHMPLKLDSLRTLLRKNGFFCILLLRLAPIHFDAVSYAAGVSKVKPLSFALATAAGIIPGTIILNVLGSSLLTGDILAIAVTAAIYLIFITVPLLFRKKVQALLD

SEQ ID NO: 7130 - protein, 310 aa, Bacillus licheniformis
MEPIKRALQGVTTRPDFKKRLEDMKEKVLSDKDVQAFLNSRQSEVDQGMIDRSLNKLYEYTQQSKACQDCPGLKECKNLIQGYHPKLVLNGKTIDVQYDRCPEKKKADERERQRSLIKSIYIQQDLLNATFADIDGDDPSRLKVLQLVTGFLHDYNETGKGKGIYVYGKFGVGKTFMLAAIANELAAKDHPSILVYVPEFVRELKNAIHDQSLEEKLDMVKSTPILMLDDIGAESMSSWVRDEVLGAILQHRMSQQLPTFFSSNFDPDELKHHFTYSQRGEKEEVKAARLMERVLYLATPVRLDGKNRRQ

SEQ ID NO: 7131 - protein, 474 aa, Bacillus licheniformis
MSNYWKDLLPVDPYVVKSSGLLQDLDRQIVTLLYQPLIGSFSFSLFLTLWGELEQNRVWGKSSTHRQLMAAMQTSLKTIHSEKEKLEGIGLLKTYIKETEHERLFIYELIPPLRPDEFFQDGMLNVFLYNRVGKARFQQLKEYFSHPSVPEEARDITRSFNEVFASVQPSEWKMSDDMIEAMELREDHEWMKEGNSQPAAVTDGAFDFQLFLAGLSDTLIPRKALTDQVKETIKKLAFLYGIEPLQMQNVVMSAVDEHDMITTEALRKAASDWYQIERGGPLPELVDKVQPMNLREQPNQQSSTNAKEDNLIALLEQVSPRKLLQDIGGGAEPSKADLKIIEEIMLDQKLEPGVINVLIYYVMLKTDMKLSKNYTQKIASHWARKKVRTVREAMKLAKEENRQYLEWAEGKKKTSRNKKVIREEKLPDWLRESDDADSKPLETEQAGPATREGFDQQKQKLLEEVKKLKNHSAL

SEQ ID NO: 7132 - protein, 152 aa, Bacillus licheniformis
MKCPACQHNGTRVLDSRPVDEGRSIRRRRECESCNYRFTTFEKVEEIPLIVVKKEGIREEFSREKMLRGLIKACEKRPVALKQLEDICFEIEKELRNQGVSEVKSDMIGEMVMDRLAKIDEVAYVRFASVYRQFKDINVFIDELKDLIKKER

SEQ ID NO: 7133 - protein, 131 aa, Bacillus licheniformis
MSLFQNIQRFFSTHAETSDRHPSEELKSRYYKAASKEALNAVKEVLEGLDGCKVTSVSEERGEISAEIKKTRKAFVVATVVSIRPFDTAVDFNVSAETFLPTDFGYSRGLSRRYTSSWSESCRNLFIQTIE

SEQ ID NO: 7134 - protein, 190 aa, Bacillus licheniformis
METMGRHVISELWGCDFDKLNDMDFIEKTFVNAALKSGAEVREVAFHKFAPQGVSGVVIISESHLTIHSFPEHGYASIDVYTCGDLDPNVAADYIAEELRAETRENIEIPRGMGPVQVKQAKAKAQAPLMPIEELDEKADTAFKIRSFFFPSPENPKTYSPAFSCCFVFPWKSTIFLIKYREERQRGQGI

SEQ ID NO: 7135 - protein, 340 aa, Bacillus licheniformis
MKVKVAINGFGRIGRMVFRKAMLDEQIDIAAINASYPPETLAHLIKYDTNHGRYELDVKAGEDCLFVNGKKVMLTNQRDPKLLPWAQYGIDIAVEATGKFNSKEKAEAHIEAGAKKVILTAPGKNEDITIVMGVNERDFDAERHTIISNASCTTNCLAPVAKVLDDAFGIENGLVTTVHAFTNDQKNIDNPHKDLRRARACGSSIIPTTTGAAKALSLVMPHLKGRMHGLALRVPVSNVSLVDLVADLKSDVTAEDINEAFRMAAAGSMSGIIDVCDEPLVSSDFNTNPYSAVIDSLSTMVLENRKVKVLAWYDNEWGYSCRVVDLIRYAASRMKHPSAV

SEQ ID NO: 7136 - protein, 494 aa, Bacillus licheniformis
MKLIKNASFIISFLAAAGIYFLLGTVAASAANEDYPEQMIRLESSSGLNITPAGNQDNAPLTAKQTSGEKEERWRLDTSDGKQFKIRNMDSGKIIIPAHYALSDNNPAVVYYDNSRKEELWNIIGADKDGNGDFITYKIVSAQNSSLALTLDGSGVKLAKYTGSSVQKWKLPSDGLEGFAGYARETNGKQKTGTTGGLLGKVVYVNNLGELKANIEDSTPRTIVVSSNIGASAKTVLTVGANKTIIGSYEKHKLNNIYFKTKADSGNVIFKNLVIAHDASINENNDIPVYITDSRNYWIDHVTFQGHSYTANGHDLDKLLYVGAKADYVTLSHSTFTDHRYGLILGWPQDDKQYHSIYNGYPRMTISHNRFENLYVRAPGLMRYGYYHVKSNYINNYHLGFTITTLAKIYSEANYFGTGNEKGILDDYGDGAFKDVGSYPAIKGQKSPETSWTPSSNYSYRTMKAGNAKAFAKRYAGAQRTALYYANYSQFKKD

SEQ ID NO: 7137 - protein, 201 aa, Bacillus licheniformis
MTLVIGLTGGIASGKSTVAQMFQQCGITVVDADVIAKEAVEQGMPAYQKIAETFGEGVLLETGDIDRRKLGEIVFANEEKRLQLNAIVHPEVRKMMIKQRDEAIRAGERFVVLDIPLLYESGLEHLTDKVIVVWVPMELQLERLMKRNRLNKDEALNRIHAQQSLDEKKKRADAVIDNSGSLKDTEAQLHQLLDTWSNIEK

SEQ ID NO: 7138 - protein, 210 aa, Bacillus licheniformis
MMFASFLLLAFAVSLDSFSVGFTYGLRKLKIPFKAILIIAFCSGAVMYIAMMIGTLLAKFLPVVVTERLGAVILMGIGAWVLYQFFRPEKEQDLVFSEKTLINLELKSLGIVIHILRKPTSADIDKSGIITGIEAFLLGFALSIDAFGAGIGAAALGFSPVPMSITVGIMSSLFVFCGIQAGRFLSKWNWMDKLTFLPGILLIMIGIWKL

SEQ ID NO: 7139 - protein, 275 aa, Bacillus licheniformis
MPELPEVETVRRTLAGLVRGKTIDAVDVRWTKIIKRPEEPEEFARLLAGQTIQSIGRRGKFLLFHLDDCVMVSHLRMEGKYGLHQNDEPLDKHVHVIFRFTDGSELRYRDVRKFGTMHLFKPGEELTELPLRQLGPEPFSSEFTADYLRERLKKTNRSVKTALLDQRTVVGLGNIYVDEALFRAGIHPEATANKLTKKQTVLLHKEIIQTLKEAVEAGGSTVRSYINSQGEIGMFQLKLFVYGRKDEPCKKCGSPIEKTVVGGRGTHFCIKCQKK

SEQ ID NO: 7140 - protein, 879 aa, Bacillus licheniformis
MTERKKLVLVDGNSLAYRAFFALPLLSNEKGIHTNAVYGFTTILMKMLEEEKPTHMLVAFDAGKTTFRHKTFKEYKGGRQKTPPELSEQLPFIRELLDAYRISRYELENYEADDIIGTLAKSAEKDGFEVKIFSGDKDLTQLATEGTTVAITKKGITDVEYYTPEHVREKYGLTPEQIIDMKGLMGDSSDNIPGVPGVGEKTAIKLLKQFHTVEELLSSIDEVSGKKLKEKLEEFKEQALMSKELATITTEAPLEVSLDSLGYEGFDREAVVKIFKDLGFHSLLERIGEEAGEKEEEQLEEIDVMIKTDITDDLFASPASLVVEQLGDNYHEAPILGFSIVNEHGAFFIPEETAVQSDCFKEWAEDESKKKWVFDAKRAAVALRWRGIELKGAEFDVLLAAYIINPGHSYDDVASVAKEHQLHIVSADEAVYGKGAKQAVPDEKELADHLARKAKAISLLREKLLDELEENEQLELFEALEMPLAHILGEMESIGVQVDVDRLKKMGEELSAKLAEYEKKIHESAGETFNINSPKQLGVILFDKLGLPVVKKTKTGYSTSADVLEKLRDKHVIIEDILHYRQIGKLQSTYVEGLLKVIKKDSHKVHTRFNQALTQTGRLSSTDPNLQNIPIRLEEGRKIRQAFVPSQKGWLIFAADYSQIELRVLAHISKDKNLIEAFTNDMDVHTKTAMDVFHVSEEEVTPAMRRQAKAVNFGIVYGISDYGLSQNLGITRKEAAAFIERYFHSFQGVKEYMEETVQEAKQRGYVTTLLSRRRYIPELTSRNFNLRSFAERTAMNTPIQGSAADIIKKAMIDMADKLKEKNLQAKLLLQVHDELIFEAPEDEIKVLEKLVPEVMEHALELDVPLKVDCASGPSWYDAK

SEQ ID NO: 7141 - protein, 581 aa, Bacillus licheniformis
MIKFRTRLLAALLTLLILVFASLGFLLVHLFHSSYDAKLSSHIEKEAALVASLANGENMKSSEQGAILEKASRELDSRVSLIDTKGQVLFHFGGRAEEQSVIKEALESDLNGEGGGFRINPDDESVYRYVQPLKDDGNVNGYILISTPVDSLQDINQKIWILLGVSLGTAFLIIAGLGARITSQYTNPIESATQVAIELAKGNYKARTFNEDETMLSQSINMLAQNLQDMTRAQEMQRDRLQTVIENIDSGLILIDGKGYIHLVNRAYQKQFHVEADQLLYHFYHEVLEHEEIINLIEEIFMTEAKVRKMFKLPIKIERRYFEVDGVPIIGINDEWKGIVLVFHDMTERKQLEEMRKDFVANVSHELKTPITSIKGFTETLLDGAMNERETLLQFLSIILKESSRLQTLIQDLLDLSKIEQQNFTLNIQNCNIGEILAEIEMLLKNKAEEKGITLTLEKPDKPAVASGDPHRLKQIFLNLVNNALTYTPEDGSVTISADVLEDAVQVKVRDTGIGIKQSEIPRIFERFYRIDKDRSRNSGGTGLGLAIVKHLVEAHQGEIDVESERGKGTEFTVRLKRASE

SEQ ID NO: 7142 - protein, 251 aa, Bacillus licheniformis
MSGKSEAWRHVMSKKILVVDDEESIVTLLKYNLERSGYHVVTAMDGEAGLLKAIEEKPDLIVLDLMLPKMDGIEVCKELRQKKLMYPILMLTAKDDEFDKVLGLELGADDYMTKPFSPREVTARVKAILRRTQTLSVQPEETEEPDAGELIIGELKILPEHYEVYFQNERLELTPKEFELLLYLGRHKGRVLTRDLLLNAVWNYDFAGDTRIVDVHISHLRDKIEKNTKKPEYIKTIRGLGYKMEEPKLND

SEQ ID NO: 7143 - protein, 312 aa, Bacillus licheniformis
MGKKRNKVSVIGAGFTGATTAFLTAQKELADVVLVDIPQLENPTKGKALDMLEASPVQGFDANITGTANYEDTAGSDIVVITAGIARKPGMSRDDLVATNEKIMRSVTKEVVKYSPDCIIIVLTNPVDAMTYAVYKESGFPKERVIGQSGILDTARFRTFVAQELNLSVKDITGFVLGGHGDDMVPLVRYSYAGGIPLETLLPKDRIDAIVERTRKGGGEIVNLLGNGSAYYAPAASLTEMVEAILKDQRRVLPTIAYLEGEYGYEGIYLGVPTIIGGNGLEQIIELELTETEKSQLDKSVESVKNVMKVLS

SEQ ID NO: 7144 - protein, 438 aa, Bacillus licheniformis
MFFYIEELHIMGGFIVAQGEKITVSGGVLNVPNNPVIPFIEGDGTGPDIWRAASRVLEAAVEKAYNGEKKITWKEVYAGEKAYNKTGEWLPEETLDTIREYLIAIKGPLTTPVGGGIRSLNVALRQELDLFTCLRPVRYFTGVPSPVKRPEDTDMVIFRENTEDIYAGIEYAKGSEEVQKLISFLKNELGVNKIRFPETSGIGIKPVSEEGTSRLVRAAIEYAIEHGRKSVTLVHKGNIMKFTEGAFKNWGYEVAEKEFGDKVFTWAEYDRIAEKDGKDAANKAQSEAEAAGKIIIKDSIADIFLQQILTRPAEFDVVATMNLNGDYISDALAAQVGGIGIAPGANINYETGHAIFEATHGTAPKYAGLDKVNPSSVILSGVLLLEHLGWNEAADLVIKSMEKTIASKVVTYDFARLMDGATEVKCSEFGDELIKNMS

SEQ ID NO: 7145 - protein, 372 aa, Bacillus licheniformis
MTATRGLEGVVATTSSVSSIIDDTLTYVGYNIDDLTEKASFEEVVYLLWHLKLPNKEELAELKKQLSENAGIPKEVIDHFKSYPNGKVHPMAALRTAVSLLGLFDEEADQMDAEANYRKAVRLQAKMPALVAAFSRIRKGLEPIEPNPELGFAANFLYMLNGKEPSPVEVEAFDKALILHADHELNASTFTARVCVATLSDVYSGITAAIGALKGPLHGGANEAVMKMLSEIGEVENVDSYIHAKLEKKEKIMGFGHRVYRQGDPRAKHLKEMSRRLTNLTGESKWYEISERTEEIVTSQKKLPPNVDFYSASVYHSLGIDHDLFTPIFAISRVSGWLAHILEQYENNRLIRPRADYTGPDMQRFIPIEERS

SEQ ID NO: 7146 - protein, 154 aa, Bacillus licheniformis
MFTQANLFLILLLAIALIAKNQSLIIAVSVLLLIKLIGLDQKLFPAIQSKGINWGVTVITIAVLVPIATGEIGFKQLGEAMKSYYAWIALGAGILVALIAKNGITLLAEDPHITTALVFGTILAVALFKGVAVGPLIGAGIAYLVMQAVQHFTS

SEQ ID NO: 7147 - protein, 371 aa, Bacillus licheniformis
MNQSYLTAALRAVYVLFLTAVCGAVGYYSFPLTYPFVIALILAIMINPFVEWLDKLTGFPRGVNVGIVLFGFLTAGAGFLTLVVAEIVSGTAYLAKILPLQFNKAALYIESFFTNQIMPLYNELAAFFDGLEAAQQESIITQVQNLGSELASGTALLLSKILETVPLFFAFLPNMAAVLIFSLLATFFISKDLHKIQNKARSVLPDRLISGAAAVYAELKRALAGFVKAQLTLVAMTMVLVLIGLSVLKVNHAVAIAFLIGLVDLLPYLGTGSVFVPWIVYLAAAKQLPLAIGLGILYIVVLVFRQLAEPKILSRSIGLHPLGTLIALFAGFKLFGFLGLIMGPALLVLIQALFTTGIFRDIWLFIKGNEK

SEQ ID NO: 7148 - protein, 128 aa, Bacillus licheniformis
MKFFLLFLVIFPASEIGLFLLSANWIGVLPTVLLIILTGFLGAALAKKQGIEVYYKVQRDLQYGKMPGAAILDGLCIFIGGMLLLLPGFLSDIIGLLLLLPATRGRFKPFISRKLKRMSEGRRINIIK

SEQ ID NO: 7149 - protein, 585 aa, Bacillus licheniformis
MRKTKIVCTIGPASESVEKLTQLMEAGMNVARLNFSHGDFEEHGARIKNIREAAGKLGKDIGILLDTKGPEIRTHTMENGSIELAAGSQLIVSMDEVIGTPDKISVTYDGLIHDVSVGSTILLDDGLVGLEVTDINKDKREIVTKVMNSGTLKNKKGVNVPGVSVNLPGITEKDANDIVFGIEQGVDFIAASFVRRPSDVLEIRELLEEHNAADIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGNYPVEAVQTMHNIASRSEEALNHKKILSARSKQVSMSITDAIGQSVAHTAINLDVNAIVTPTESGHTARMISKYRPQAPIVAVTVNDAVSRKLSLVFGVFATSGQNHSSTDEMLEKAVQKSLDTGIVRHGDLIVITAGAVGEAGTTNLMKVYVVGDVVAKGQGIGRKSAFGEVVIAQNAQEAAKKMKDGAVLVTKSTDRDMMASLEKAGCADYGRRRLNKPRAVVGLSLGIPVIVGMENATSILKEGEDITVDSARGAVYKGRASVL

SEQ ID NO: 7150 - protein, 322 aa, Bacillus licheniformis
MKKMKRIGVLTSGGDSPGMNAAVRAVVRKAIYHDVEVYGIYNGYSGLISGKIEKLEIGSVGDIIHRGGTKLYTARCPEFKTVEGREKGIANLKKYGIEGLVVIGGDGSYMGAKKLTEHGFPCVGVPGTIDNDIPGTDLTIGFDTALNTVIDAIDKIRDTATSHERTYVIEVMGRHAGDIALWSGLAGGAESILIPEADYDMEEIIARLKRGHERGKKHSIIIVAEGVGSGVEFGKRIEEATNLETRVSVLGHIQRGGSPTAADRVLASRLGAFAVELLLEGKGGRCVGIQNNQLVHHDIIEILEQKHTIDQSMYRLSQELSI

SEQ ID NO: 7151 - protein, 325 aa, Bacillus licheniformis
MAGELEFEKPVVELREKISELKKFTQDSDMDLSSEITKLEARLERLEEDIYTNLKAWDRVQIARHPNRPTTLDYIEHLFTDFFECHGDRYFGDDEAIVGGIAKFRGLPVTVIGQQRGKDTKENIRRNFGMPHPEGYRKALRLMKQADKFNRPIICFIDTKGAYPGKAAEERGQSEAIAKNLFEMAGLSVPVISIVIGEGGSGGALALGVANRLLMLENSTYSVISPEGAAAILWKDSGLAKKAAETMKITAPDLKELDIIDHVIKEVRGGAHRDVEQQAAYIDEALKGELKSLLKLDKNELIQQRYNKYKSIGKISTENQYVGIK

SEQ ID NO: 7152 - protein, 291 aa, Bacillus licheniformis
MLKDIFSKKKKKYASVPAESAKQDVPEGIMTKCPDCKKIMLTKELDKNLRVCMNCGYHLQMNAKQRIKSLLDDGSFEEFNQDMMSENPLEFPGYLEKLQKDREKTSLNEAVVTGKGTIDGSPAVVAVMDSSFRMGSMGSVVGEKITLAIEKAREEKVPFIIFTASGGARMQEGLLSLMQMAKTSSALKLFSEEQGLIISVMTHPTTGGVSASFASLGDYNLAEPGALIGFAGRRIIEQTIREELPEDFQTAEFLLKHGQLDSVVHRADMKKTLGSILKMHQTGGDLEWLEN

SEQ ID NO: 7153 - protein, 406 aa, Bacillus licheniformis
MSLKEKALHMHKVNQGKLESKSKVQVRNADDLSLAYSPGVAEPCKAIYDDNSKVYDYTMKGNMVAVVSDGTAVLGLGNIGPEAALPVMEGKAVLFKSFAGVDAFPICLNTSDVDKIVETVKLLEPTFGGVNLEDIAAPNCFVIEERLKKETKIPVFHDDQHGTAIVTVAGLVNALKLSGKTMSSVKVVANGAGAAGIAIIKLLYHFGVRDIIMCDTKGAIYEGRPNGMNAVKEEVAKYTNKNRIDGSLKDVIKDADVFIGVSVEGALTKEMVESMADKPIIFAMANPNPEIMPAEAHEAGASVVGTGRSDFPNQVNNVLAFPGIFRGALDVRATHINEEMKIAAVDAIASLVSDEELRPEYVIPAPFDPRVAPAVAKAVAKAAMETGVHESMSIQKKSLKKQESLQ

SEQ ID NO: 7154 - protein, 1114 aa, Bacillus licheniformis
MPFVHLQVHSGYSLLNSAASVEDLTAKAKELGYSAMALTDDEVMYGAVEFYKSCKKRGIKPIIGLTASVLTDEKEQLSYPLVLLAKTNKGYQNLLKISSVLQSKSKTGIKEKWLKSYHEGLIALTTGGTSHVEALLKEGLIEEAKDAALRCLSIFGEGSFYLSYQPYKGDPLLSERILELSEHTGIPIAATGDVRYIEKEDAAAYTCLKAIKAGEKLNEDMKAEGDLHLELKPPAEMLDIYRDRPDALENTVKIADRCQVDLSLGQTRLPKYPAPSGKNADDYLAELCFLGLKKRFEAAPKEYVERLKYELKVIRDMAFSDYFLIVWDFMKFAHDNGIITGPGRGSAAGSLVAYTLFITDVDPLKHKLLFERFLNPERISMPDIDIDFPDTRRDEVIQYVKNKYGALHVAQITTFGTLAAKAALRDVGRVMGISPKEADQLAKLIPSKPGVTLKEARALSPELDKRLNGSKKLQDIFKTAQKIEGLPRHTSIHAAGVVLSEEPLTNIIPVQEGHGGVYLTQYSMGYLEDLGLLKMDFLGLRNLTLIESIKTLIEKSERVTIDFSAIPYDDEQTFKLLAEGDTTGIFQLESAGMRNVLKRLKPSSLEDIVAVNALYRPGPMENIPLYIERKHGRVPVSYPHEDLADILKDTYGVIVYQEQIMMIASRMAGFRLGEADLLRRAVGKKNKEILDTERNHFISGCLKKGYSVQAANEVYDLIVKFANYGFNRSHAVAYSMIGYQLAYLKAHYPLYFMCGLLTSAIGNEEKLAQYIYEAKGKGLNVLGPSINKSGYPFVVENGALRYSLRAVKGVGIAAVKEIYRARKEKPFADLFDFCVRTSVKSVNRKTIEALIFAGAMDEFGENRATLLASVDVALEHAELFAGDNDQLGFFLDEGLTIKPKYAETEEMPLVDLLAHEKETLGIYFSDHPLSVHRKKLDRAGALPIIQLLASGRKKAALGGLLTRMKTIRTKTGQTMAFLELSDESGEMEAVVFPEQFRQLSPILEEGVSLFAEGRLETRNEKRQLIISGASLVESLHAKKQPSVYIKVEESQHTHDIFKKISSILLEHKGETPVCVYYEKRKQTMQLPESYNIKADHAALYRLKSVVGEKNVVLR

SEQ ID NO: 7155 - protein, 113 aa, Bacillus licheniformis
MDPEQPFFPNFISCYFIALGVLLGGCLIGGIGAYLSGQPPLTIITSLANRLKIWALVAAIGGTFDAVYSFERGIIEGNTRDIVKQLLLILSAMGGAQTGYLIINWLTQEHISS

SEQ ID NO: 7156 - protein, 167 aa, Bacillus licheniformis
MRIPPYYKKPGWQRFFAGMMCGAIISWFVFLFTYGTFQEKQVVLIREQKERINDLNDQITIYREDLHKLNEDNKRKLLIQSVDVKLINGKQYKLSQPDMMNFEEHIRDNISDVITKDIESVYRTKELLKRTIENKEYTINDKKYKAKVTELTIYTRLSVEIKISFSE

SEQ ID NO: 7157 - protein, 59 aa, Bacillus licheniformis
MYIYSYHQLARDKVNRIKLGYSAYAETESLASLIKKELKAQNIHVYEDVTDIGSWFIPE

SEQ ID NO: 7158 - protein, 314 aa, Bacillus licheniformis
MKKEIIRTISLYDTIIIHRHVRPDPDAYGSQCGLTEILRATYPEKNIFAVGAPEPSLAFLYTPDVIEDPVYENALVIVCDTANQARISDSRYNLGDKLIKIDHHPNEDRYGDLLWVDTSASSTSEMIYELYLAGKEQAGWALPTKGAELIYAGIVGDTGRFLFPNTTKKTLKYAGELIEYPFSSQALFDQLYETKLNVVRLNGYIYQNVSLSENGVASVFITRDILHQYNITPSEASQLVSTLGNISGIKAWVFFVEEADQIRVRLRSKGPIVNEVAKKYNGGGHPLAAGASIYDWKDADLVIADLERICKENK

SEQ ID NO: 7159 - protein, 100 aa, Bacillus licheniformis
MPFFVFFIVVSAIAYVYFKVRYVRTKKAVEREYYSAKSSMSLGLFIMFFGANQLILNRGTLAVVIGVIFMLTGLGSMWAGYKAYKHYVPLLAKENERENA

SEQ ID NO: 7160 - protein, 445 aa, Bacillus licheniformis
MKVKRLATKHEQILKYIDSLSVGEKISVRRIAKEMKVSEGTAYRAIKEAENKGFVSTIERVGTIRIEQKKKENIEKLTYAEVVNVIDGHVLGGKAGLHKTLNKFVIGAMKLDAMMRYTGAGNLLIVGNRIDAHRQALEAGAAVLVTGGFDTEPEIIELADRLELPVISTSYDTFTVAAMINRAIYDQLIKKEVVLVEDILTPLEKTVCLSPHEKLERWYEKNFETGHGRFPIVDEQMKIHGILTSKDVAGYDRSVLIEKVMTKNPITVIGKTSVASAAQMMVWEGIEVLPVVDERQKLIGMISRQDVLKALQMIQKQPQVGEKLDDIVTGGFKESDHDKNKPAPVYQYEVTPQMTNHLGTISYGVFTTILTEAANRFLRSRKKGELVIESMTIYFLKPVQMESVIEIKPNILEAGRKFGKMDIEVFHQGALVGKAMMMVQLMERS

SEQ ID NO: 7161 - protein, 117 aa, Bacillus licheniformis
MYSITEAGKRELHGWLTEFKPVPDTVKDEFMLKAYFISSMEPDEAKRLFNDQLQKRQEKAAFLNTKLDELKREAGDSITFRSPHFGHYLVLTRALEREKGYCSWLEKALLLMEDDKA

SEQ ID NO: 7162 - protein, 228 aa, Bacillus licheniformis
MKVAYHGHSVVTVDTGDHQLIFDPFITGNSLTDLKPEDVKADVILLTHGHNDHVGDTIEIAKRNNSLVVAPNELAVYLGWKGLNVHPMHIGGSHQFDFGKVKLTQAFHGSAYTEEDSQKIVYTGMPAGILLTVEGRTIFHAGDTGLFSDMKLIGELNHIDLAFLPIGDNFTMGPEDAKLAAEWLRAKQVVPVHYSTFPVIEQDPHAFADSLPGGVGKVLEVGESIEFK

SEQ ID NO: 7163 - protein, 224 aa, Bacillus licheniformis
MNYRQDEEAVRRLKEKWRSSLDRLQFVKGDVTRKEDLLRMVNAALERFGKIDLLINNAGPYIFERKKLADYTDDEWYDMLEGNLSSVFHLFKAVVPIMRRQRFGRIITYGFQGADHAPGWLHRSAFGAAKVGLASLTKTIAIEEAGSGITANMVCPGNIVGDMKEASISEARASLDEETPIGRSGTGEDIARIITFLCDEHSDYITGTVIEATGGLNVINRHSL

SEQ ID NO: 7164 - protein, 47 aa, Bacillus licheniformis
MKQDQSKHGYMYDADGDKETVQQISDAYFSGFVAHDDAQPLADADKQ

SEQ ID NO: 7165 - protein, 459 aa, Bacillus licheniformis
MKKLWGGRFQKTPEKWVDEFGASIHFDKTLVKEDIAGSLAHASMLEKCGILTEAEAVKIKEGLTSLLHKAEKNELDFSVDCEDIHLNLEKMLIDEIGPLGGKLHTARSRNDQVATDMHLYLKGHTEHIIELITAFQHVLIEKAEEHVETILPGYTHLQRAQPISFAHHLLAYFWMLERDKERYHDSFKRINKSPLGCGALAGTTFPIDREYSADLLGFDSIYENSLDGVSDRDFILEFLSASSILMMHLSRFSEEIILWCSQEFKFIELDDTYATGSSMMPQKKNPDMAELIRGKTGRVYGDLIGLLTIMKGLPLAYNKDLQEDKEGMFDTVKTVEGSLEIFAGMIKTMTVNKNMMKKATEQDFSNATELADYLAKKGMPFREAHEVVGRLVFTCIEKGIYLSGLPFEEFKKASGLFEEDVYIVLDPHHAVEKRMSEGGTGFKKVTEAIQKAKQCLNNF

SEQ ID NO: 7166 - protein, 403 aa, Bacillus licheniformis
MTQKKKVVLAYSGGLDTSVAIKWLQEQGYDVVACCLDVGEGKDLAFVQQKALQVGASNSYVIDAKEEFAKEFALTALQAHTLYEGKYPLVSALSRPLIAKKLVEVAEKENAQAVAHGCTGKGNDQVRFEVSIKSLNPDLEVLAPVREWKWSRDEEIAYAEKHGIPIPINLDSPYSIDQNLWGRSNECGVLEDPWAAPPEGAYDLTKPLEKTPDTPDVIEIAFEEGVPVSIDGTHYPLSDLILKLNELAGAHGVGRIDHVENRLVGIKSREVYECPGAMTLIKAHKELEDLTLVKEVAHFKPIIEQKMAEVIYNGLWFSPLKDALSGFLKETQKHVTGVVRVKLFKGHAIVEGRKSEYSLYDEKLATYTKDDAFDHHAAVGFIELWGLPTKVNSIVQKKEQIKA

SEQ ID NO: 7167 - protein, 172 aa, Bacillus licheniformis
MSVEEHKKEAPDCVNCKVITVSDTRTEDTDKSGRLMKEFLAEAGHEIVSYEIVKDEKEIIQKAVLKGCLDDRIDAVLLNGGTGIASRDVTIESIVPLFSKEIPGFGEIFRMLSYTEDIGAAAILSRAAAGVIQNKAVFATPGSSGAVKLAMSKLIVPELAHVIRELRKDMKK

SEQ ID NO: 7168 - protein, 395 aa, Bacillus licheniformis
MSKIIAINAGSSSLKFQLFEMPSEKVLTKGLVERIGLDNGIFTISVNDEKKTETTDIPDHSVAVKMLLDKLTKFGIIKDLNEIDGIGHRVVHGGEKFSDSVLLTDEMIHEIEEISELAPLHNPANIVGIKAFKEVLPNVPAVAVFDTAFHQTMPEQSYLYSLPYEYYEKFGIRKYGFHGTSHKYVTERAAELLGRPIEELRLISCHLGNGASIAAVEGGKSIDTSMGFTPLAGVAMGTRSGNIDPALIPFIMEKTGQTADEVLDTLNKKSGLLGISGFSSDLRDIVEATKEGNERAETALEVFASRIHKYIGSYAARMSGVDAIIFTAGIGENSVEVRERVLHGLEFMGVYWDPALNNVRGKEAFISYPHSPVKVIVIPTNEEVMIARDVVRLAH

SEQ ID NO: 7169 - protein, 328 aa, Bacillus licheniformis
MQNYPVETIYEWLDKGAEVIARDRQIPYIEGLAEAGEAFFTGSADRGLSEEAEQKVKDLIGRARFSECSHESIRKAFQLAILKGQKDIPHPNRQMTPDTIGLFIGYLVNKFMERKKGLTLFDPAVGTGNLLLAVLNQLAEEAGKAFGSEIDDVLIKLAYVQANLQEKEIELFNQDSLQPIFMEHADAVICDLPVGYYPDDESARAFELKADEGHSFSHHLFIEQSLTYTKPGGYLFFMIPNHLFESGQSEKLRTFLKNNAHINAVLQLPLSIFKDEAHAKSILVLQKHGEQAKAPKQVLLAQVPSFANQDAMLNMTAKLDSWFQAEKR

SEQ ID NO: 7170 - protein, 167 aa, Bacillus licheniformis
MASITFKGNPVTLVGSEVKVGDQAPDFTVLSNSLEEVTLQDIKGKPAVISVIPSIDTGVCDAQTRRFNEEAAGLGSVKVYTISADLPFAQARWCGANGIENVETLSDHREMSFGEAFGVYIKELRLLARAVFVLDENGKVVYTEYVSEATNHPDYDKAIEAAKSLVK

SEQ ID NO: 7171 - protein, 152 aa, Bacillus licheniformis
MAEHPIQGLMKTAMENLKEMIDVNTIIGDPVETPDGSVILTVSRVGFGFAAGGSEFGGNKPAESKASDGDRERKESKLPFGGGSGGGVSITPIAFLIVGSSGVKVLHLDENTHVIDKILDSAPQTIERIQHMFKKNDKQKQNMNRQNQTPPF

SEQ ID NO: 7172 - protein, 227 aa, Bacillus licheniformis
MIYIWIAGVFILLAALMIMKIRVAIEYLHTDDDDRLTVKVRTAFGILRIKREIPVIKINQEDMTVDVKEQTNSALKKDKKRRKIGYREVFDSTKQIKKLVEQIINMQPIIRRFMKRIHVTKLEWTSVLGFPDAALTGIVTGGAWSLKAGTVALLHQLFCFDSQPEYEVIPAFNSRSSKTHLTCIFHFRVGHAITAAFRIVVNWKGKMRGLFKLPKNLSGSTKNDSSV

SEQ ID NO: 7173 - protein, 172 aa, Bacillus licheniformis
MDVTYDGKDHNELSPNVGVSREESAPHVEHAYAGFWIRLFAFLLDGVVIGSINNLAVSPVFSLLNLPKESGFFTFSLYSFVTAAVFFAYFVLMTKYFGQTLGKMVFGLKVVSLVPEKGLTWDVVLFREFIGRYINSLYITYLVAAFSPKKQGIHDFFADTAVIHEKLYRKKD

SEQ ID NO: 7174 - protein, 335 aa, Bacillus licheniformis
MNAKRWIALVIALGVFALSAVMSLLLAVFDTMGNDGKMQFGLNDTQEETVLEQGNSSRKIAVLEVNGTISDNGGASGLFSSEGYNHRSFLQMLEKAKDDSAVKGIVLRVNSPGGGVYESAEIHKKLEEIKKDTKKPIYVSMGSMAASGGYYISTPADKIFAAPDTLTGSLGVIMESLNYSKLAEKLGLKTETIKSGEFKDIMSPTRDMTKKEREIMQSMVDDAYEGFVDVIAEGRGMSENDVKKIADGRVYDGRQAKQNHLIDELGYYEDAVKAMKKDHKNLAGASVVSYEESAGLASLFSMTANKMFKSEADFLNIKEAISQSGAPRLMYLYAK

SEQ ID NO: 7175 - protein, 265 aa, Bacillus licheniformis
MTDRRNIYFFYKKSEETDEQCKKLKQLAEEHGFRVVHHHNEANIIASIGGDGTFLQAVRKTNFRDDCLYVGVAKKGKAHLYADFNIYDTDKMIEATNSEQIEVRKYPLIDVTVDGTSFQCLNEVSIRSSIIKTFVMDVYIDDLHFETFRGDGMIVSTPTGSTAYNKSVDGAIVDPLIPCIQVTELASLNNNTYRTLGSPFILSADRKLTLKIVQDGNDYPIIGLDNEAFSTMNVKEVEVSLSGKMIKTIKLKDNSFWEKVRRTFL

SEQ ID NO: 7176 - protein, 211 aa, Bacillus licheniformis
MSKGRLMIINMIGIIATLALVAVCGYYYYQNKHYVTTDEARVSANMTKITAPASGKLSGWDAKEGDHISDGDNLGKISDGQQSVAVKAISDGTLVKNTAVNHKIVNAGVVIGQTADMDNIYITAHIKETELRDIEKDDKVDIKVDGDPDTTFEGKVEEIGYATDSVFSMFPEMNQSGDYTKVTEKVQVKISIQNPSAKLLPGMNAEVKISL

SEQ ID NO: 7177 - protein, 540 aa, Bacillus licheniformis
MSQSDVAIPSSKKIGIPKYLIISVLTILAIGPQYFLNLSYTLSQVVIQNGLHLSPDDMRIPSILTNLAFALGVPLGRIFSRRFGIRNSYLTLITLFLCGSLIDAFSAGLFSLLIGRVIQGLCSGMLFLTILPVKLISFPNKVRNLFLFFVISGLFGASAIGAVFGSLSLSADAWRWVFILNICSPVLCLVIGFFSLPKQAADEREHHSIDKTGVFMLSLLMVVLTVPLINLQKTGVHSFYVWPFFLAGFIILALFVITDLRAREPLVPFRSLWSAKAVSGTVMAVASHIAIIVSLAGINGFLENIAEASFESMTRFYLCFFAGILATAVLSTLLYDHFGAGLLGCIGALEMIIVGMEWRSVQPGVSMESLYLHAVLLGSGVSMVLVSGALGTALAGDIHQASKRSVSLHFIRNFAGAWAAPVIGWFASMKNAVHYEMIRGHISEADPEIQLELSKMIRDFVSSGLSVGDAKNMAAYTIVANARKASALGAYHDLFTILLWLSIIMLAASIGKAATGKGRSLVQKRLRLPDPSASQQKEIG

SEQ ID NO: 7178 - protein, 142 aa, Bacillus licheniformis
MGHDSLRNIEKEIALLVRLTTAYSPRFGSLDRSEYLLLSELDKQSPLAINSLAETLMLNLSTASRQVSALERKKLIRRFPDPNNGRISLVEMTSEGIDALKKVQKARYHVYTEVLQDWTTEELNTLETRLIRLNQDFKKWSK

SEQ ID NO: 7179 - protein, 529 aa, Bacillus licheniformis
MRREDLIAPEKYNAVDEIEKFKSSRDKTALIWEDESGRQVSWSYEKLIEKAYKIGSILTRSGLKKGDKLIVMMPRIPETYAVYMAILKAGMVVIPCSEMLRAKDLDYRIKHAGVKGAVVYSAFLDAFLDVRSKEALSLFAVGESSEGWINLLEKMNQAIAADFQAADTSRDDIAFLSYTSGTTGQPKGVVHTHGWAYAHLRTTASAWLDISEGDLVWATAGPGWQKWVWSPFLAVLGSGATGFIYHGKFTPETYLRLIERHQVNVLCCTPTEYRFMAKVNDLSRFDLSSLHSAVSAGEPLNREVIDTFKKHFHIAVRDGYGQTESTLLVGILKGMKIKPGSMGKPTPGNLVDIIDGNGKSCPPGETGDIAVHLSTPALFKEYYKDQERTLRQRRGDYFITGDKARKDEDGYFWFESRNDDVIISSGYTIGPFEVEDALIKHPEVKECAVVASPDEIRGSIVKAYVVLKDPSRGNEHLTKELQDHVKAMTAPYKYPREIEFIEELPKTPSAKIKRFELRQREIALKTKAE

SEQ ID NO: 7180 - protein, 70 aa, Bacillus licheniformis
MAQNNRQSSSNQLLVPGAAQAIDQMKFEIASEFGVNLGAETTSRANGSVGGEITKRLVSFAQQQMGGTQQ

SEQ ID NO: 7181 - protein, 401 aa, Bacillus licheniformis
MNEDYILIRFGEISTKGKNRKLFVDRLKRNIKMVLRDFRNVRYESTRDRMTLVLNGEDAEAVMARLKHVFGIQSFSLAVKCRTDLESIKETALASVQEQYKPGDTFKVSTKRAYKQFELNTNEMNAEIGGHILRNTDDLTVDVHSPDIHLRIEIREDATYLTFRDEKGAGGLPVGSGGKAMLMISGGIDSPVAGFYAMKRGLEIEAVHFFSPPYTSERAKQKVIDLTKRLTAFGGDIKLHIVPFTKTQELIQKQIPENYSMTATRRLMLQIADKLRERHNALAIFTGESLGQVASQTLESMYAINAVTSTPVLRPLIGMDKTEIIEKAKEIDTYDISIRPYEDCCTIFTPSAPKTRPKKEKIEHFESYTDFEPLINEAVENTETIVLSSKAETKDQFADFF

SEQ ID NO: 7182 - protein, 381 aa, Bacillus licheniformis
MIYLDNSSTTKPYPELLQIYEQVNQRFFGNPSSLHRHGVEADQLLSEARKQIKSALSLKNHDIVFTSGASEANNMALKGIALAHAQKGKHIIASSIEHPSVTESLEQLKTAFGFEVTYLPVDGHGFVSLEDLKQALRKDTILVSIMHVNNETGVIQPLEEIGKIVKENTRAYFHVDHVQGINKVPLDISGAAIDLCTISGHKFHGLKGTGALILNERISLFPLISGGEQQNNRRAGTENTAGAVTLAKAINLSKQDYNHYIEEIKAAKSAFIKELKELKGVILNTPEENSAPHIINFSVPGLKAEVLLHMLEERDIFVSTTSACSSKQHKPSKVLLEMGKGEGAASSSIRISMTYRDNHEIVGPFMTALKESLHKLKGIMR

SEQ ID NO: 7183 - protein, 445 aa, Bacillus licheniformis
MKTSLSAKETTAIGLMLFALFFGAGNMIFPPQLGQAAGENIWPAIIGFLLTGVGLPLLGVIAVALKGSAKGLADKAHPVFGTILIVSIYLTIGPLFAIPRTGNVSYVIAVEPFLGKHSSSLYLFIFTLIFFGITYFLALNPSKLVDRIGKILTPILLTVIAILVIKAFITPMGSIGSVTEAYQSAPLFVGFLEGYKTMDAIASIVFGIVVITAIKDRGVTNPKSIAASCIKAGIVAAVGLGLVYVSLAYLGATSVETVGSLDNGGEILSKASAYLFGSLGNAVLGIAILFACLTTSVGLVSSCGEYFSNLIPKLSYKAVVIIVTLFSLVIANFGLTEIISFSVPILSAIYPLAIVVVLLSFIDKLFNERREVYIGTLIPTGILSIIDGLNAAKIPLGPVNDILKANIPLFSMGVGWVVPAVIGAVIGYIVTFFIALPEDKLKNVS

SEQ ID NO: 7184 - protein, 110 aa, Bacillus licheniformis; identical to SEQ ID NO: 4682

SEQ ID NO: 7185 - protein, 286 aa, Bacillus licheniformis; identical to SEQ ID NO: 4681

SEQ ID NO: 7186 - protein, 564 aa, Bacillus licheniformis
MEFVIGLLALFLILFATGYLFRKNIYKEIDRLEAWKIEIMNRSIVEEMSKIKHLKMTGQTEEFFERWRREWDEIVTSHMPKVEELLFEAEDCADKYRFQKSKQVLAHIENLLSAAESNIEDILKEIADLVSSEEQNRKEIEEVKERYTKVRKNLLAYSHLYGDLYAKIEADLDTVWEGIKQFEEETEGGNYIEARKVLLAQDRLLEELQSYIDDVPKLLASCKQTVPQEIAKLKAGYQEMIDKGYKLDHIQVEKELENLLKELKRAEDALLDELDLEEAAAIVQIIDETIQTLYNQLEHEVEAGQEILGKVPELAAALEKLEASKKDTEAETELVKKGYRLTTGELEKQQSYEKRLEMIEKQFEQVRERLDQKHVAYSLLKEELADIEKQMEAAQREHDEYRDMLQMLRKEELQARELLKQLKQTIKDTARSLEKSNVPGIPEAITEKIRQSQTTVQKVTEQLNELPLNMDAVNERLQEAEQLVTEVKTKTDELVELVLLIERIIQYGNRFRSQDRILSEQLKEAENCFYAYQYEEAYDIAARAVEKASPGAVARLEADAKQPE

SEQ ID NO: 7187 - protein, 270 aa, Bacillus licheniformis
MLKRDGHVHSPFCPHGSKDEFRYYIEELCKKGFQSVSFTEHAPLPPSFIDPTPEKDSAMPISQLGRYIERLTELKEEYRGQLDILIGLEVDYIRAFEHETKAFLDQYGTHLDDSILSVHFLPAGSSYICLDYDEKAFQQLIDCYGSTEQVYLAYYDEIYSSIVSPLGAFKPKRIGHITLAKKFVKLFPYTMSESVRKSVSSCLDEAAKRGLELDFNTAGLRKPYAGNVYMEEWMIKEAEQKNIPLVFGSDAHQAEDAGFGYEHFESRFVK

SEQ ID NO: 7188 - protein, 212 aa, Bacillus licheniformis
MGSNATPTTKDRIIESAVELFNQKGFSGTSVREIARAANVNVAHISYYFNGKGGLMEHLVSRFYEGYLRILEKGHERLQDAGATDCLLQLVFDILSYQHEHRQLTRFVYREVTIDSTLNREVMSTYLTKEKYILHLIIEKGNEDNEFSRFPLSHFMIQLKSLLMMPYLQPQYISEVLYVQPHEPYFYQAYYKEVKTWLLSLLYRERRQAAVI

SEQ ID NO: 7189 - protein, 164 aa, Bacillus licheniformis
MFHVEKTEGSKEKKYELLLKQIDALTEGEPDMIANTANASALLYQSLEDVNWAGFYFAKDGELVLGPFQGLPACVRIPFGKGVCGTAYTNGRVERVEDVNAFPGHIACDAASQSEIVVPLEVDGSIIGVLDIDSPIKNRFDETDEYYLKKFTEKLGERLSEKSR

SEQ ID NO: 7190 - protein, 566 aa, Bacillus licheniformis
MNKQTEDLYLTFHQKLFQFFLKKPAVSYDDSVAWLKAAAESFFSFISLTVQPSSRLQGSRGDGDPIRRVSDYHTIITIEENSKYIELSCQKKHKLPERLAESIHLFLVHCLELDALFRDELKKTKIYEKTELLHELMDQEQVLKTMLESLRSVFPFLTYCLFLSYDEDQYINLPAIELDVQSESTDSFALEAYLSGQEKSKNEAEVYIPIKGRQGTYGVLKAFGPGAADTAADICIISNAAGKAFENSRLYEQSQNMISNLELINETSHQLNRTKRLPDMMKSLSERLISSFGAEEVGFFYKNHLGKETLLPESTSFFQTDEALPYIRYVKEKISEENGVFVGNGSSLFGNEGYASLMGVPMLENNENKGFVIVLKKNVCSFSFEMFKLFQTLIRHSTLAVSNLMLRDRLKYLVQTDRLTELYSRSHLDEKIGYSMKLDESGVLVLIDIDDFKQINDTYGHQKGDDILIQVARVIQRNIRDQDVAARWGGEELAVYLPKARLNAGEMLAERLIMLVRECTDPTVTISCGVSHWSQDRPKSLSDLFKEADVALYNAKRNGKNKFMTH

SEQ ID NO: 7191 - protein, 200 aa, Bacillus licheniformis
MARYTGPSWKLSRRLGISLSGTGKELEKRPYAPGPHGPGQRKKLSEYGLQLQEKQKLRHMYGVNERQFRNLFDKAAKMAGKHGENFMILLESRLDNIVYRLGLARTRRQARQLVNHGHVLVDGSRVDIPSYQVKPGQTISLREKSQNLSVVKEAVEVNNFVPEYLTFDAEKLEGSLTRLPERSELPAEINEALIVEFYSR

SEQ ID NO: 7192 - protein, 76 aa, Bacillus licheniformis
MLLFFAKFVLFYVFCSVAFALFKVMYYNISKKWVTKTAEGTKLNWALNVFLNTARKWTATTALLWGVLAGWCAIYL

SEQ ID NO: 7193 - protein, 145 aa, Bacillus licheniformis
MKWYWRGLKNYANFEGRARRKEYWLFHVFNGIICFILFILSLMVVSLFISGIMTAEGYDRYQVGYIIGYGGGFLGYILIFIYQLAVLVPSLAVNVRRLHDTGRSGWWILIGFLPIIGAVILLIFYCQAGEAKENQYGPNPKVNVS

SEQ ID NO: 7194 - protein, 253 aa, Bacillus licheniformis
MNIQQIRNATLAVKYAGKTFLIDPMLAEKGAYPPFPNSARQEQNNPLVSLPVPTDELVKNTDAVIVTHLHLDHFDDAAKDLLPKEIKLFVQNEADAEEVRKAGFQNIEVLTKDTGFEGIQLIKTKGEHGRGEILKLAGEVCGVVFKHSKEKTLYVAGDTVWYEGVREEIAAHQPDVIVVNGGDNQFFEGGSLVMGKEDIAEVYQAAPKATIISSHMEAVNHWTLSRKELKSFIQEKGMSSRVLVPDDGESYTF

SEQ ID NO: 7195 - protein, 139 aa, Bacillus licheniformis
MLDHTDKQIIEELSKNSRMTMKELGEKVHLTGQAASARVAKLEDQGVIEGYTIQVNQVKLGCFIHAFINIYTKSTYHKPYLSFIKAQQKYIIHNYKISGDGCYLLECKFPSNQQLDQFLIDLNHHANYKLSIVINKTGG

SEQ ID NO: 7196 - protein, 75 aa, Bacillus licheniformis
MYVHSGNVKNIDVIGRAFPSLKREECSMNLFIAAKEKFMEDYHKQLETERKQEVQQSADGYNQLNQTENAAKRLK

SEQ ID NO: 7197 - protein, 421 aa, Bacillus licheniformis
MTHILDDLSFRGLIQQQTDEAGLRELLDKEKISLYSGFDPTADSLHIGHLLPILMLRRFQLAGHRPIALVGGATGLIGDPSGKKAERTLNNEEIVREWSQKIKNQLSRFLDFEAEENPAIMANNYDWIGKMNVIDFLRDVGKNFGINYMLAKDTVSSRIETGISYTEFSYMILQSLDFLNLYRNQECKLQIGGSDQWGNITSGLELIRKSEENAKAFGLTIPLVTKADGTKFGKTEGGAIWLDKEKTSAYEFYQFWINTDDRDVVKYLKYFTFLSKEEIEDLAEKTETAPEKREAQKRLAEEVTVLVHGREAFEQAVNISKALFSGDIKQLTAEEVKVGFKGVPSLEVEKADELPLVEILVQSKLSPSKRQAREDITNGAVYVNGERRTDVADVLTADDRIEGQFTVIRRGKKKYFLLTYK

SEQ ID NO: 7198 - protein, 572 aa, Bacillus licheniformis
MKLKALPAEKGNYNLKDYDETYRTFDWKDAEKHFSWHKTGKINAAYEAIDRHAESNLKNKVAFYYKDPVREEKYTFREMKNETNKAGNVLKQHADVGKGDRVFVFMPRSPELYFILLGAIKLGAIVGPLFEAFMEGAVKDRLANSGAKVIVTTPELLERVPADELPDLESIIVVGEGVKEEGPVIDYYAKAAEAGTDLEIEWVDQEDGMLLHYTSGSTGAPKGVLHVHKAMIQHYQTAKWVLDLHDDDIYWCTADPGWVTGTVYGIFGPWLNGATNVVVGGRFSPEAWYETIEKMEVTVWYSAPTAFRMLMGAGDDLVNKYNLSSLRHILSVGEPLNPEVIRWGHKVFGNRIHDTWWMTETGSQLICNYPCMEIKPGSMGKPIPGVEAAIVDNQGNELPPYRMGNLAIKKGWPSMMHSIWNNPEKYSSYFMPGDWYVSGDSAYMDEDGYFWFQGRIDDVIMTSGERVGPFEVESKLVEHQAVAEAGVIGKPDPVRGEIIKAFIALRDGYEPSDALKEEIRQFVKQGLAAHAAPREIEFKDKLPKTRSGKIMRRVLKAWELNLPAGDLSSMED

SEQ ID NO: 7199 - protein, 210 aa, Bacillus licheniformis
MEHHKTYHAKELQTEKGSVLIEGPISPEKLAEYEFHDELTAFRPSQKQHEALIEIAGLPEGRIIIARFRQTIVGYVTYVYPDPLERWSEGNMENLIELGAIEVIPAFRGHSVGKTLLAVSMMDPQMEKYIIITTEYYWHWDLKGTNKDVWEYRKMMEKMMNAGGLVWFATDDPEISSHPANCLMARIGKEVSQESIERFDRLRFHNRFMY

SEQ ID NO: 7200 - protein, 214 aa, Bacillus licheniformis
MIVEKIMKRDVVTLSRTDTIEEAIKRMRTFHIKHLPVINERGTVIGIVTDRDVKTASPSIFAQNRSNEDLKKPVELIMSKEVITGHPLDFAEEISAVFFEHEIGCLPIVKNGKLVGIVTKSDLLHTFVQLTGAHFPGSQIEIKTDHIARSLADISAIFSRRQIAILSVLVYPGDEDDSKILVFRVQTMNPASIIKDVKSKGYQVLWPAVQRDLP

SEQ ID NO: 7201 - protein, 395 aa, Bacillus licheniformis
MAGCSKGFAMKDSVFIFSPSYQTYQFHQDHPFNQLRVYVTYDLLNTVGAFEPGETIAPRAATETELELVHTGDYIRAVQLAGAGKLPAAESENYGLGTEDTPVFAGMHEAASLLVGGTLTAADYVMTGKARHALNLGGGLHHGFRGRASGFCVYNDSSVVIRYLQKKYHAKVLYIDTDAHHGDGVQFTFYDDPSVCTVSIHETGRYLFPGTGQVQERGHGEGYGYAFNIPLDAFTEDESFLDSYRTAVSEIAEFFKPDVILSQNGADAHYYDPLTHLCTTMKIYEEIPKLAHELAHTYCSGRWIAVGGGGYDIWRVVPRAWARIWLEMKGMEPEEKMPEKWLKKWGKQASVRLPANWSDPEDLYPPIPRKTEITEKNAQTVAKALYPIRSAQRTT

SEQ ID NO: 7202 - protein, 229 aa, Bacillus licheniformis
MKLRHERRKREQGRKSPNWIITFSDLITLILVFFILLFSMSQIDLNKFKAAVGSFQDRADGKSAAELKKDAGDQKAEKTAKSQDDLLKKINDYIEKNELSSLIAAKRDERGVILVLQEAVLFDSGKADLKDQAHPLLHKIAVLLKSVSNPIRVEGHTDSRPISTYRFPSNWELSAARASTVIGYFTSKEKLDSSRFLAIGYADTKPVRDNRTESHMKENRRVEIVIAKQ

SEQ ID NO: 7203 - protein, 272 aa, Bacillus licheniformis
MKRFDYLTPVGFILGIFILVLGVVSGAGLSGFYSFIDLTSFFIVTGGLCAAVFISFSPKDLKRAPAVLKQVFISEEDDVRELVKTFVSLSEQARKQGILSLDANVNEMKDPFLKKGLLLAIDGWDEETIRNVMNSEIAAMEERHRKGRRIFEKAGEFAPAWGMIGTLVGLVMMLKNLNKPETLGPNMAIALLTTLYGSLLANMLFIPIAAKLEEKTENEIFKKQVMIEGIIGIQSGRNPRNLESQLVVFSSKEEWTKKRADRMKQKDRPHEA

SEQ ID NO: 7204 - protein, 333 aa, Bacillus licheniformis
MSNVTIYDVAREANVSMATVSRVVNGNPNVKPTTRKKVLEAIERLGYRPNAVARGLASKKTTTVGVIIPDISSIFYSELARGIEDIATMYKYNIILSNSDQNMDKELHLLNTMLGKQVDGIVFMSGNVTEEHVEEFKRSPVPIVLAASVEEKGETPSVAIDYEQAIYDAATMLIEKGHKRLAFVSGPMAEPVNQAKKLQGFKRALGDKGLQFKEEYVVEGDYTYDSGMEALEALMKLDEKPTAVLSATDEMALGVIHAAQDKGLAVPDDLEVIGFDNTRLSLMVRPQLSTVVQPTYDIGAVAMRLLTKLMNKEEVEEHIVQLPHRIELRQSTK

SEQ ID NO: 7205 - protein, 358 aa, Bacillus licheniformis
MSNTELDLLRQQANELNLQILKLINERGRIVQEIGKAKEAQGINRYDPVRERAMLNEIIENNDGPFENSTIQHIFKEIFKAGLELQEDDHSKALLVSRKKKPENTIVDLKGEKIGDGEQRFIVGPCAVESYEQVAEVAAAAKKQGLKLLRGGAFKPRTSPYDFQGLGVEGLQILKRVADEYDLAVISEIVNPQHIEEAIDYIDVIQIGARNMQNFELLKAAGSVKKPVLLKRGLAATLKEFINAAEYIMSQGNDQIILCERGIRTYETATRNTLDISAVPILKQETHLPVFVDVTHSTGRRDLLLPTAKAALAIGADGVMAEVHPDPSVALSDSAQQMDIPTFEKWLNELKPLVQVKA

SEQ ID NO: 7206 - protein, 149 aa, Bacillus licheniformis
MNTELKYMLQSVLKEELSPINQRLDGIDKRLDKIDARFVEIDKRFDEVDARFVEVDKRFNAIDKRFKEIDGRLNKVENRLNAMDKRLNRLETDIDELKRGQERLPKTIIENIGQFTENIVEHADDKAAALNDRVFSVETAIQRIYRLSS

SEQ ID NO: 7207 - protein, 108 aa, Bacillus licheniformis
MSKQLIQTEDEFKRLAENNDTFIFLKHSVTCPISRRAFEEFESFANQHEDIPAYYLKVQESRPLSNYIAEQYGIKHESPQAFIFTNGNVKWHASHSQITAQALAENSR

SEQ ID NO: 7208 - protein, 138 aa, Bacillus licheniformis
MSKDGMNTKDFLIGTFVGGIIGAAAALFLAPKSGKELRDDLGNQAVVLKDKTGKLTSEARERGSEYVSIAKEKTSSISQLVADQSSQIMDKVKDLRSKGAEKAGELKEEASSAIEEQAEEAKNEIEDEARKTADTAQK

SEQ ID NO: 7209 - protein, 140 aa, Bacillus licheniformis
MIIILYLSAALIAVSFLILVIYLSKTLKSLQVTLNHVASTLEGVEGQMKGITAETTELLNKTNRLADDIQEKSLKLNTVVDAVQEVGTSVRQFNNSIQQVSQSVTSAAEQNREKISQVVSWSNAALEIWNRWKQKKMREE

SEQ ID NO: 7210 - protein, 432 aa, Bacillus licheniformis
MTVYHFVGIKGTGMSPLAQILHDNGYNVQGSDIEKYIFTQTALEERNIPIYPFDPENIKPGMTVIAGNAFPDTHPEIEKAQAEGLPVVRYHKFLGDYLKKFTSIAVTGAHGKTSTTGLLSHVIKKAKPTSYLIGDGTGKGCENSEYFVLEACEYRRHFLSYQPDYAIMTNIDFDHPDYFANIDDVFDAFQTMALQVNKGIIACGDDEYLMKIHANVPVVYYGFAEKNDFQARNVIKNTEGTTFDVFVRNTFYDTFYIPAYGSHNVLNALAVIALCHYEQVDVDIIKEGLQTFGGVKRRFNEKHAGSQVLIDDYAHHPTEITVTIEAARQKYPERDIVAVFQPHTFTRTQSFLNEFAESLKKADYVYLCDIFGSARENAGKLTIGDLQEKIPQAKLIDENDTSILKEHENAVLIFMGAGDIQKYLRAYENVLA

SEQ ID NO: 7211 - protein, 930 aa, Bacillus licheniformis
MSWFNKMFSLFLGDDEDNEKQKKHIDEFEADSSSEDEEMPQITDAKVVYEYPKGKFRFPVIPDQNTRPREKDDSREQRTRRPASRYSASQPKPGNSYHYEEKAAAKKPFRPSVIPSPVYGFHEQKRAKPENHTYRAKKQTEARVTLFNEEIEKEQKSAEHKQPVREEASVQTEKNGRPLIKSESRNPALRAEFEDVPQASTEIPKETEIRPERMTEGAGLAEEKALRHESERTEAPVSVHIPEETEVRPERMTEGAGLAEEKALRNEAVEETASASQNITEEDAIPAEQTPEQIEKLLDKIEETGEEMVLAEDAEAATEEQGKTYGSGKTHPDPEASVPEEPHTHGRASEITVQSDESSHRTDSNTPADALEETSGSRQTGWRQEQASCSPETAAPSAGEPESRQENRETTRINEDRPEAPRKREAGAAPGSKKGSVPFNVMMFASDKQKEKAPQGYQFPNMSLLDVPPAQKQDDQDWIHEQRELLDVTLENFNVKANVVHVTQGPSVTRFEVHPEPGVKVNKITNLSDDIKLSLSAKDIRIEAPIPGKNTIGIEVPNLHSKMVYLREMIRSSEFRTNPSPLTAALGLDISGKPVVADLKKMPHGLIAGATGSGKSVCINTILVSLLFKASPRDVKLLLIDPKMVELAPYNNIPHLVSPVITDAKAATAALKWVVEEMERRYELFAHSGVREIERFNEKVREQNMGEKLPYLVVVIDELADLMMVAPNEVEESICRIAQKARACGIHLLIATQRPSVDVITGLIKANIPTRIAFSVSSAVDSRTIIDMAGAEKLLGKGDMLFLENGSGKPVRLQGNFVSDREIDRVVSHVRRQQEPNYLFEQEQLVRQNPAGFDHDELFLEACEFAVEQNSASTSSLQRRFRIGYNRAARLIDMMEREGMISEAKGSKPREVLITKADLEQLIESSSLFG

SEQ ID NO: 7212 - protein, 201 aa, Bacillus licheniformis
MNAFYNPEGVGDTLLISLNDIPREEIAFERYGDVVKIFHKDTKETAGYNIFNASSYLSIEESGAIALSESFVQDVNEILVRNGLKDELTVDLSPKFVVGYVEEKEKHPNADKLSVCKVNVGSETLQIVCGAPNVEAGQKVVVAKVGAVMPSGMIIKDAELRGVASSGMICSAKELNLPDAPKEKGILVLDDGRKAGEAFTF

SEQ ID NO: 7213 - protein, 269 aa, Bacillus licheniformis
MKMTSRKLSDILKKRLQNDSWSFHFDREKDSLRIEDKNTGKGITLELPGIIAKWEQKKDDAIDEVVYYTEEALNAMKGQSQEMEGRESLIYPVIRSTSFPEKSSAGVPLVFDGHTAETRIYYALDLGNTYRLIDEKMLEKEGWTKERIRETASFNLRSLQTVVKEDEVAGNHFYFFRANDGYDASRVLNESILAEYEKNAEGTLAVSIPHQDVLIIADIRNNAGYDILGQMSMSFFANGTVPITALSFLYEDGKLEPIFILAKNRPKKK

SEQ ID NO: 7214 - protein, 106 aa, Bacillus licheniformis
MKTIETNEELQKVVKDDLSLLMFSADWCPDCRFVEPFLPELEANYPEFTFYYVDRDKFIDTCAEWDIFGIPSFLVFKEGNEISRFVSKDRKTKEEIEQFLTDSLNK

SEQ ID NO: 7215 - protein, 148 aa, Bacillus licheniformis
MEFIVYLAGEIHSNWREEVKEKAKSLKLPITFVGPMENHERSDNIGEEIMGKQADSIAKDDAASDLNNFRTSVLMNKADVVIALFGEKYKQWNTAMDASYAIAKGKPLIIIRPESLHHPLKELSNKANITVETVNQAIKSLSYVFESR

SEQ ID NO: 7216 - protein, 357 aa, Bacillus licheniformis
MNQETRTLFQTLTELPGAPGNEHLVRRFMKKELEKYADEIIQDRLGSVFGVKHGPEGSPKIMVAGHMDEVGFMVTSITDNGLLRFQTLGGWWSQVLLAQRVEIHTDNGPIPGVIASTPPHLLTDEQRRRPMDIKNMMIDIGADDREDAERIGVKPGQQIVPICPFTPMANEKKILAKAWDNRYGCGLSIELLKELQGTELPNNLYSGATVQEELGTRGAQTAANMIQPDLFFALDASPANDSSGDKNQFGQLGKGVLLRIFDRTMVMDSEMRNFVLDTAETNDIPYQYFVSPGGTDAGRVHISNEGVPSAVIGICSRYIHTSASIIHVDDYLAAKELLIKLVKACDSSAVQSILRNE

SEQ ID NO: 7217 - protein, 104 aa, Bacillus licheniformis
MKLRHFLIGAGIGIAAAVVVKQYVMQPYISSEKALRIVKSAFKQRGPIDGSWIYTVPEAYTVNGETVMVYKTGITRSAFRELEQYEVMVDAKTGMIVDVIDTAA

SEQ ID NO: 7218 - protein, 571 aa, Bacillus licheniformis
MKGRRRVSHNKLNEQVIETRLRGFEVLATPLLNKGVAFPPEERDALGLTGLLPPKVLTLEEQAKRAYKQFQSQPDDLSKNVYLTALHDRNEVLFYRLLNDHMTEMLPIVYTPTVGTAIQQYSHEYRKPRGLFLSVNDPEGMKTAFENLAAKRSRIDLIVATDAEGILGIGDWGVGGIAISIGKLAVYTAAAGIDPNRVLPVVIDAGTNQERLLNDPLYVGNQHSRIRGERYESFIDQYVQIATETFPGVLLHWEDFGTQNARQILKKYKDKICTFNDDIQGTGAVTLAAVLAAVKISKMPLKDHKVVIFGAGTAGIGNAEQIRAALVQEGVSEEESYRRFWCVDRNGLLTDDMNDLQDIQQPYARPADEVKDFSRNGPGDAIDLLEVVKRVQPTILIGTSTVSGAFTEEIVKEMAKHVKRPAIFPMSNPTPLSEARPEDLINWTEGRALVATGSPFAPVEYSGTRYAIGQANNAFVFPGLGLGTLVSKARLITDNMFYASAAAIAGMVDTGRPGAALLPEVEDLRTVSATVATAVIKAAIEDGVAENEPDDVIQAVQDAMWHPVYRPIRAI

SEQ ID NO: 7219 - protein, 281 aa, Bacillus licheniformis
METLTIGRIKLTWLNGGVTHMDGGAMFGVVPKPLWSKKYYANEKNQIELRTDPILVQKDGTNLLIDSGIGLGKLTDKQKRNYGVTEESSIDDSLKALGLSTEDIKAVLMTHLHFDHACGLTRYEGESLVSVFPNAAIYTSAIEWEEMRNPNIRSKNTYWKENWEAVQHQVRTFDEKLEVLPGITMHHTGGHSDGHSVIVLEDAGETALHMADIMPTHAHQNPLWVLAYDDYPMTSIAAKQAWQAKAAEKNAWYIFYHDALYRALKWDENGDIAESVKRESR

SEQ ID NO: 7220 - protein, 213 aa, Bacillus licheniformis
MRMRHKPWADDYLAENSHIVISEPSQYKGKWHSVFGNDNPIHIEVGTGKGQFISGMALQNPDVNYIGIELFKSVIVTAVDKVKQTEAPNVKLLNINANMLSDVFADGEVDRVYLNFSDPWPKKRHEKRRLTNHAFLKKYEQVLGGKGAIHFKTDNRGLFEYSLTSFSEYGLVLTFVSLDLHQSDFEGNVMTEYEEKFAAKGQPIYRVEAEWRT

SEQ ID NO: 7221 - protein, 92 aa, Bacillus licheniformis
MGLNQQNQIHLLKDILSDHQADCTGTVAECEQMERIIKSLMANTNLDAGLKGVLEDIYLYSQKGRSSASINNHIQEHQDYLTQWVEDIDSFS

SEQ ID NO: 7222 - protein, 271 aa, Bacillus licheniformis
MKIDMNWLGQLLGSEWEISPAGGATGDAYYAEHNGQQLFLKRNSSPFLAVLSAEGIVPKLVWTKRMENGDVITAQHWLKGRELKPKDMNSQAVAEMLRKIHSSKELLDMLKRLGKQPFQPSSVITQLKQFIQARQYPIPQLDQALLYLEHHLEDVQSGEKVVCHCDVNHNNWLLTDQNQLYLIDWDGAMIADPAIDLGPLLYHYVEEREWGSWLERYGSSLTDNLRLRMAWYVLAEKAMTTLWQKAKGNQEGFHQGLEQLHELMERLARSS

SEQ ID NO: 7223 - protein, 710 aa, Bacillus licheniformis
MPGISRPFEAYLDEMRTITVLVPKSRASSCSPPFLLEDDQGERIELSVKAQVELEEQFKYVLESSCTVPFGRVHKVCCEESVWTDLQIGSVTRSAAFDKAFFYDGRLGAFYSKGSTLFKVWAPTASAAAIKLEDPDSLQTNTFQMMRRKKGVFEVTVEGDLNGWSYLYELYVNGKPLLTVDPYAKAVTANGEKGVVLDPEEVKVEKHRAPRLHSPCDAVIYEVHIRDFSIHEDSGMRHKGKYVAFTEDGTETSGGFSTGIAYLKELGVTHIEVLPFHDFAGVDELSPDQSYNWGYNPLHFNAPEGSYSLDPQNPKCRITELKTMIQSLHKHGFSVIMDAVYNHVYKRETSPFEKTVPGYFFRHNEYGFPSDGTGVGNDIASERLMVRKYILDSVRYWLEEYDVDGIRFDLMGILDIETVRQISTLAENVKPGVPLFGEGWDLNTPLDSGQKATLQNAGKVPAVGFFNDRFRNAVKGSTFELSDRGYALGDTGKKAALQHGIAGSPGFLQPAQSINYVECHDNHTFWDKMALCFEEDADTKRLRQRLAVSIVLLSQGVPFLHAGQEFCRTKNGDSNSYRSGDDINKLDWEKRAELCEDVEYVRQLIRLRRSHPAFRLQKEEEVKEHLSFMDGTGEVTAYKLKNIAAIDPWNEIIVVHCPFAKKETLKLPDQKQYLLHCDPFTFFNGKVQAEKRLRLNGIGTYVLYEPKGIF

SEQ ID NO: 7224 - protein, 306 aa, Bacillus licheniformis
MSDWYIIINPKAGNSTAFRAWKSLQKDLQKANISYRSFMTQHPGHAEVLARQISTMQDDRLKRLLVIGGDGTVHEVLNGLVSLRDIQLSVIPSGISNDFKRGFGVKKSNVIKEMKRKGQSLTRTYALGSFHTKDSENELYFANHLSLGFDACTAKKMSALPKWTAALRLNHLIHPLIFFVTAFTFKPFVLSYENGDDKRTFKKIWFASVSNHPYYGGGMKIAPNANPRDELLDVIIIEDLPVLKKAGLLFAMIFGKHVGKNGVTAFKTKDIYFHTNERVLFQADGEVIGWAPVFIKTGTESLRLRA

SEQ ID NO: 7225 - protein, 313 aa, Bacillus licheniformis
MAQIIKIQDCISRYEQDPYHYINQFIRLKKQRWQSIKEMAEKKKESFHHDKGAAGDETFGKRKNTFTLKRKKEASDINKGKEADEWFNGLDGETDESLIARIPAAGEELVPFFKEYVYEFQLKWASSTISDISRLSREIKSDKILHILAQQLPDSYFIMYRPVLQVNQAAVELSVLILTPLEIYCMSFLEGERDSAFIGSKDRFWKEKTVRGKERSLLNPAVELLRTGKVLSGLLKGSGIELPVRKVIVSRTSYIDYPEPPYGIGICDKRHWKEWLEKQQKNFAPIKSQQLKTAKILLSHGVSDSVRRQEWLS

SEQ ID NO: 7226 - protein, 201 aa, Bacillus licheniformis
MSVKPHYFIGIPIPAELSDPLYQTVSSRPEFSFHRWVHPLDYHITLVFLGSAEKEQLAMLAGSLKLISDETAPFQLAIKRFGTFGKPSEPRILHVEPEYSAALFHVREQVKHAADAAGFEIEKRPFHPHVTVARKWNGSASFNGRLEPLEDAVSFTARHFTIFQTHLDRLPKYEHQAVFHFGERPAAEKQDSEMNADGTDY

SEQ ID NO: 7227 - protein, 310 aa, Bacillus licheniformis
MRAVQNIAELIGETPLVKLNRVQPENAAQVYIKLESFNPSGSVKDRAAYQMILDAEEKGLLKPGSTIIEPTSGNTGIGLAMNAAARGYKAILVMPDTMTKERINLLKAYGAEVVLTPGDERMPGSIKKAQELARQIPGSFIPMQFDNEANPEAHRRSTALEIARAIEEIGKPLAAFVATAGTGGTITGTGEKLKALFPGITVHVAEPAGSPVLSGGKPGKHKLVGTSPGFIPNILNENVYDEILKIKDEEAYEMTRRLAREEGILVGPSSGAACFAAVETAKKLPPDKVVVCMTADTGERYLSSDLFQFD

SEQ ID NO: 7228 - protein, 157 aa, Bacillus licheniformis
MSHKRGVLFEIPNGYGRFLLDILKPVEPADFNWLLADGECYLVENGELSDENLFPQDPQVMTGEAFKKRLEDARYYLIFADLKAFPKDGHPEDVSTYESYMKSSCELIVLTADSSFVTIYCKDQKNLELLYQNAKDCGFKRIEYITDHNDARTGMHV

SEQ ID NO: 7229 - protein, 463 aa, Bacillus licheniformis
MNWEQEVLKRRNEIVEDIQGFLKINSVLDEETAGPGRPFGKGIQECLTALLNKGEESGFTVKNLDGYAGHIEWGKGEEIIGVLCHIDVVPPGDGWTSDPFAAEIRGGRIYARGALDDKGPTMAAFHALKIVKDSGLPLSKRIRMIIGTDEESDWRCVEHYFKHEEMPSAGFAPDADFPIIYAEKGLIDAALKIETDQAETGADLVLEAFRSGRRLNMVPDDAEAVLAGAVPSEFEESFARFVKEKRAEGRILQEGGRLTLTVHGKSAHAMEPNNGVNAGLILAEFLHTQSLDRAGLHFVQTVSGAFAGDTRGKKIGIGCRDDISGELTLNVGRLQYEQGKGGEAHINIRYPVTEESGRVKSGLSQIKGARLISFKDSKPHHVAKDHELIKTLQRVYEEQTGETAQLISIGGATYARSLKAGVAFGPLFPGRPDVAHQKDEYMEIDDLLKAVSIYAQAIYELAK

SEQ ID NO: 7230 - protein, 439 aa, Bacillus licheniformis
MEEMMFNIKENQTTVKKEILAGITTFFTMVYIVVVNPSILSGTGVPFDQVFTATIIAAVVGTLWMALAANFPIAIAPGMGLNVYFAVSVVGSSNGEISYQTAFSTVFAAGILFIILSLTPLRKQLIEAIPANLKYGITAGIGLFIAFVGLRGAGIITANEANLVGLGNLHSPGVILALIGLAFSVVLMVMNVSGALFFGMILTGLIAFFTGQLEFTKGIMSMPHLPEKLIVTNPFAAFGDVIHYGLYSVVFSFLLVTIFDTTGTMIGVAEQAGLMKNNKLPNARKALLADSTATTVGAMFGTSPTTAYIESSAGVAAGGRTGLTSLTVAVLFGAALFFSPLVSAVSGIAAITSPALIIVGSMMIGAVTNIRWKELDEAFPAFLVILTMPLTSSIATGISLGFIAYPIVKAAKGKWREIHPLVFVFAVLFFIHLFFLEGH

SEQ ID NO: 7231 - protein, 73 aa, Bacillus licheniformis
MKPSTNRMLTRIKSVYMFIQEKGLVTTQELVDEFGTTPRTIQRDLNVLAYNDLVHSPSRGKWETTRKKVKISS

SEQ ID NO: 7232 - protein, 240 aa, Bacillus licheniformis
MRLDKLLSNSGYGSRKEVKKMLKNGAVRVNDQLVKDAKKHVDPESDDITVYGAPVMYREFIYLMMNKPQGVLSATEDSRQETVVDLLDPELLRFEPFPVGRLDKDTEGLLLLTNDGQLAHQLLSPKKHVPKTYEVHVNKPIDQAALDQLEKGVDIGEGYVTKPAEASLLASENGVERLLLTITEGKFHQVKRMLKAVGHDVIYLKRLKMGDVDLDEELLPGEYRELSEHELAALQNKKTL

SEQ ID NO: 7233 - protein, 542 aa, Bacillus licheniformis
MSSKLLRGTFVLTLGTYISRILGMIYLIPFGAMVGATGGALFQYGYNQYTIFLSIATMGFPAAVSKFVSKYNSMGDYETTRRMLRAGMSMMLVTGIIAFSILYLSAPFFAEMALGGTENNGLTLEHVVYVIRMVSLALLVVPILALIRGFFQGHQMMGPTAVSQVVEQIARIVFLLTATYLVIKVLNGGLVVAVGYATFAALIGAFAGLFTLYFSWQKRKGALLALKPNLVPSADITYRQMFKELFSYAAPYVFVGLAIPLYQYIDTNTFNKAMIAAGYQNISQDLMAIVTLYVPKLVMIPVSLATAFGLTLIPAVTENFTNKDFPALNKQIDQAMQIILFIVLPASVGMALLSGPVYTFFYGSESLLPEMGRDILFWYAPVALLFSLFTVNAAILQGVNKQKFAVVSLMIGIVIKIALNVPLIKLLQGSGSILATALGYSASLLYGFIMIKRHAGYSYRKLFKRFLLMLILTAVMGIILLLVQALLSIFISYEGGQIRSAVVIFITTAVGGSVYLYLAYRVKLLEKIFGQRLNRFFKRKAS

SEQ ID NO: 7234 - protein, 424 aa, Bacillus licheniformis
MKYFDVIVIGGGPSGLMAAIAAGEQGADVLLIDKGNKLGRKLAISGGGRCNVTNRLPVDEIIRHIPGNGRFLYSAFSEFNNEDIIKFFERLGVKLKEEDHGRMFPVSDKAQSVVDALLTRLEQLHVSVRTNEKVKTVLYNEEKACGIVTGSGEEIAAGSVVIAVGGKSVPHTGSTGDGYEWAEKAGHTITELFPTEVPVTSDEPFINQKTLQGLSLRNVALSVLNKKGKPVITHQMDMIFTHFGLSGPAVLRCSQFVVKELKKQEKVRLKIDLFPDIHEEQLFQRMHKELKDAPKKSLKNVLKPWMQERYLLFLFERNKIDPSETFSSLSKDRFRAFVKDCKEFTVNVNGTLSLDKAFVTGGGVSVKEIDPKKMASKKKEGLYFCGEILDIHGYTGGYNITSALVTGRLAGLNAGEFSLCRRKK

SEQ ID NO: 7235 - protein, 510 aa, Bacillus licheniformis
MKNISSVFWIVIVITAAAVLWGIVAPDNLQALTTSIQGYVTNTLGWYYLLVVSLFVAFSIFLIFSPIGKIRLGKPEEKPEFSRLSWFAMLFSAGMGIGLVFYGAAEPISHYAISSPSGETETAQAFRDSLRYTFFHWGLHAWAIYAIVALCIAYFQFRKDAPGLISATLFPVFGDRVNGPLGKGIDCIAVFATVVGVATSLGIGATQINGGLHYLFGVPNSFQVQLAIIAVITVLFLISAWSGIGKGIKYLSNTNMVLAGVLMIFMLFVGPTVLIMNSFTDTIGTYISNVVQMSFRLAPNDPDSREWINSWTIFYWAWWISWSPFVGIFIARVSRGRTIREFLIAVLFAPTVLAFLWFSIFGVSAMDLQQKGIFNVAKLSTDTMLFGMFDHYPLAMITSIVALLLIAVFFITSADSATFVLGMQTTYGSLNPENSVKISWGIIQSAMAGALLYSGGLSALQNTAILAALPFSVVVILMIVSLYKSLSQERKEIKQAEKFQKPRSPRVKKA

SEQ ID NO: 7236 - protein, 60 aa, Bacillus licheniformis
MLKVAVFDEEHEKDLQHEINEFLKKLSEDQLVDIKYDVSAACDPQGEQLYCFSALILYRT

SEQ ID NO: 7237 - protein, 104 aa, Bacillus licheniformis
MTIKEISPDELKDRLAKGETLNIIDVREDEEVAEGMIPEAVHIKMGDIPEKLDVFQKDQPYIFVCRSGKRSENVCLYLQDKGFDVTNMVGGMLEWTGNTKPKTK

SEQ ID NO: 7238 - protein, 317 aa, Bacillus licheniformis
MFSAVGLSLQIDDGAVSESAELFRKIKRQKETVKSADDIIQYYFFFFSGMYEFYEKNYFEAISCYKKAEAKLHKLTDEIEKAEFYYKIATAYYQIDDHFRSLNYSEKALSLFSKHKEYIDKTIGCEMILGSVQFELFRIKQAEEHYGRALDQAVALQNRRIIGLIYHNMGLNYAKCGMPLLAEEHFRKALSIGVHEQSVFGINTLFELSHLMYKNGSPEEARRLCKEGFTRSAELGEDEYAAKFRLIFALYDAGHPLDIEFSLEYMSDKRLWPHVAELTKDIADYYMKSGDHEKSALYLEKSQHAKNQIYKMKEGII

SEQ ID NO: 7239 - protein, 119 aa, Bacillus licheniformis
MGEEFEKRYLYWIDEAVKESEKKDDFKSLPGYGKPLSKEMLEGDALSSTLKNARYLPEWLKLQKEIKQEIEKAIKSNQRETLIDAINQKIKKYNLTCPNQFQKGLVSAKNLESQLKYWS

SEQ ID NO: 7240 - protein, 215 aa, Bacillus licheniformis
MEQNVSMGRVLSFCEWVLKFFYANLLWFVFTMLGLGVFGFMPATTALFSVTRKWIMGKTDIPIFKTFWQAYRGEFFRSNAIGLILAAAGIIIYVDLAFIYPDHLLLHVLRFVIMVFGFLFLIMLFYMFPLLAHFDWKKRMYFKFSLILGISYLQYTLTMMAVTAMLYIAFAFLPGIVPFFSASLLSYAVMWLAYQVLKKAEAAEQKETVITTRHT

SEQ ID NO: 7241 - protein, 425 aa, Bacillus licheniformis
MKKYAICGLSGRAFNMFIEPLVGKYGKENRIAALLDIDPLREEVCKERFPALRPVPFFEEKAFTEMLDKIKPDAIIVAGRDDTHVRYILGALRADIDVITEKPMVTTARDAAAVLKAEAESKGKVTVTFNYRYNPYHRKIKELILDGKLGTITSVDLNWYIDTYHGASYFKRWNRMRAFSGGLSVHKSTHHFDLVNWWLDQTPQRGFAYGGLYYYGPRGEMNPEKGENRYCGTCHVKKKCRYYMRWQAGDPQDDHVKTNESQHLLYTDYRPDACIFDEEIDIEDTYAAVLKYGKGALLNYSVHFSAPYEGYRLAINGTKGRLETQEYHAPARVPFEVPEQTIDYYPLFESKETIRVVRQPGGHGGGDPLLLEELFGGGDPLRNYDILAGAEAGAYSIAAGEALWRSIKEKKPIGISELLHTRQYT

SEQ ID NO: 7242 - protein, 134 aa, Bacillus licheniformis
MIFSDAPAEVKENVQRAVGKEQLNITVFPATPEKLLVEIAAKEGDLFIVPEDMFKPFYDPEGLQPLNAASEEKEPYSAPGKNGEVQLYAAVIEKGEKRLNGYTVQLNTDMAAFIPVYAKKTPEATELIEALQAK

SEQ ID NO: 7243 - protein, 373 aa, Bacillus licheniformis
MNQSLITKSPLYIAEEAAKTIMKAYTPKELPPAGRWHYHQGVFLCGLIRLWEETGKEAYFKYVKEYADDLIDDCGNFYFRRDELDAIQAGLLLYPLYEETGDERYRKAAKKLRGLFETLNQTEEGGFWHKDKYPYQMWLDGLYMGGPFALKYARAFNEPELYDKVILEEKLMRKHTKDCRTGLYYHAWDEKRQMPWADPVSGCSPEFWGRSIGWYALALSDMIELLPQGHSTRQEWTRTLQEMVKSIADFQDESTGLWHQVVDKGGLPDNWLESSCSCLYMYAMAKGARMGYIDSSYIDRATKAFKGLVEEKIEMSAKEGLLLKDICVGTSAGTYDYYVGREKSTNDLHGVGALVMAFVELEKTGRFSCGEAK

SEQ ID NO: 7244 - protein, 321 aa, Bacillus licheniformis
MKAADVQTGKNPALVVGKKRKTRFWEKLLQQKYLYLMILPGLIYFLLFKYVPMWGIVIAFQDYQPFLGITGSEWVGFKHFERLFTEPTFFMLLKNTLILFFLNLVVFFPIPIILALLLNEVRVALFKKFVQTLIYIPHFMSWVIVVSLSFVLLTVDGGLINEIIAYFGGEKINFLLNESWFRPMYILQVIWREAGWSTIIYLAAITAVDPQLYEAAKMDGANRLRRMWHVTLPAIRSVIVVLLILKIGDTLELGFEHVYLLLNATNREVAEIFDTYVYTAGLKQGQFSYSTAVGLFKAAVGLILVVFANRMAKKFGEEGIY

SEQ ID NO: 7245 - protein, 769 aa, Bacillus licheniformis
MKRKQYKFYYKLVTFFLILSTIPVIIVGFFSYQRSAETIEQNVTNEKLQTVSQTQLNIEHILKTVDHSFTNYVRSYPLIQTLSRTITPERFQLYNQINKELNELQTFDTDLSDITLISQEKKWYINNSGLYPLDQGKQAITLSLYNALKSRSSWVLEKNNDLVATKEGASGNCLYNVNLVKQLPLNSMENRGLAIASIPSCSLVKRMPDHSKTNSMMVLDDNGRIILHSDPSMIGQSIKQENYFKTIRRHQEKNGQFDTTVSDTAYNITYQKSDYNNWIYVSLTTIPELYQQTASIGWFTFTICLILLALSYLFSWFGSRHFYRPIKVLYESVSGFSPGADSVQEKPKNEFELIERNIKEMKNKNHDLKVRVEQQVTQLKQYFLTRLLLGKLSEEEIKDRFTGLGFPEDWSHLSVFTLQIDTLKDTSYEKKDLDVLLFAINSLVERSVPKNKRLPPVVIDKTQTIIMLNRGQPLERFQEDLEHTASAIKDKIHEELGLFVSIGISQPFTSLAMSKRGYLEGLEALTYRLKSGKHAVIFYEHLDRNKAFLTQFPKQIQNELFEAIKTCNRKQAAEQLHLLLESICSENMNPHHCQIAIARLLNNLIEFMHLLGIEIFEPNENTMLYDDVFELTTIEEIESWLNAQIIVKMIDTLSIREESQYKNISEKIVHIIQQEFDTDLTLESIAGRLHYNPNYLSSIFRKEMKISFSEYLSSYRHHIAKNWLTETTMSVKEISEKLKYKNPQNFIRSFKKLEGITPGKYRELKNHSA

SEQ ID NO: 7246 - protein, 501 aa, Bacillus licheniformis
MGKKWLIPIFAFVLLAGGLLGCSNSGADQASSKEEKVDLNSPLDLSWMVILYHQQPPKDTAIKKIEELTNTKLDLMWVPDAVKEDRLNSALAAGNLPKVVTIQDIKNSSVMNAFRSGMFWEVGPYLKDYPNLSKMNKLINKNASIDGKLYGIYRERPLSRQGIVIRKDWLDNLGLDMPKTVDELYETAKAFTEKDPDQNGKNDTIGFADRNDLIYGAFKTLGSYMGMPTDWEEKDGKFTPDFMTKEYMDTMKYMKKLYDEGLINKDFPVTSKTQQQEMFSQGKAGIYVGNMVDAVNLRDQSVDDKMELEIINRIKGPDGKERVWASGGHNGIFAFPKTSVKTEKELKRILAFFDRIAEEDVYSLMTYGIEGVHYKKEGNKQFKRIDEKLKDWQAEIQPLVSLVGIDKQYLKNTGDPLRTKYEELTEDNNEIIVSNPAESLYSPAASERGDELQKIIDDATYQFILGKINESQFEKAVEKWRTNGGNQVIEEYEESFKKAEK

SEQ ID NO: 7247 - protein, 278 aa, Bacillus licheniformis
MNYSFLTGFGLVCVLPFIHVIAASFATVEEVISKKFILIPTTFSLDAYRYIFSTDIVYRSLIVSILVTAVGTAVSMFLSSLMAYGLSRKELMGRRVLMFLVVFTMLFSGGMIPTFLVVKSLGLLDTYWSLILPTAINAFNLIILKNFFQNIPSSLEESAKIDGCNDIGIFFRIILPLSLPAIATISLFYAVTYWNTYMQAILYLSDATKWPIQVLLRQIVIVSSGMQGDMTEMGAAAAPPEQTIKMAVIVVATIPVLLVYPFIQKHFAKGALLGSIKG

SEQ ID NO: 7248 - protein, 254 aa, Bacillus licheniformis
MKKVTIVGGNGTVGRVLAGGLAGEGYEVTVLDLKEPDDKQAVRFIRVDATDYNEVVKSIPAQTNALINLLAVKPSGDLLDRQEFAKMTDIFFKATYTILRAAAELGVPKVVFASSNHVTDVYEKGGDSLLGRQINTNDYPQSKSLYGLLKLASENLGYLFSHQLDAKVSVINLRIGTAAENELETLHAKPRSKKTLLSHPDLIGIFKAAIKSGKTYGTYYAVSDNKGRPWSIDSAIRELGYRPQVSASDILDED

SEQ ID NO: 7249 - protein, 295 aa, Bacillus licheniformis
MRSQLFKLLGDLPGKKSIDASTLKIEEKSSFILETLLLDLNGIEAVPAYFAKPKQMNGKRPAVLYCHSHGGRYERGKEELVEGAEYLQAPPFAEELTALGFSVLAIDHWAFGDRRGKTESEIFKEMLWTGRVMWGMMVFDSIRAIDYLKMREDIDESRIASLGMSMGGLMAWWTAALDERVSVCVDICAQVDSETLIKTQNLDRHNLYSYVPGLVKHFSTAQIESLIAPRPHLSLVGTADKLTPVQGIDIIEEKLSDVYIEKGAGERYEVFRSHSGHLETAGMRHKAVGFLKTWL

SEQ ID NO: 7250 - protein, 416 aa, Bacillus licheniformis
MREKKLGPLLLSGLMTGPILGSGIILLPPMIHQTAGDYAIFAWLLMLGIGFLFAWVFARLSVEYPNDAGIAYAAEKAFGSRVKKLAVFYFIMAASFGPAAVLMTAGEYIHSLAAGTAFPAELYGFVFFIFCMVILCFNLSFVGMVALIFSTAAALILFGSSAASVPYFREGPLVDGTFQFTDFGRGLLLLFWALVGWEIVGNYSMEVKNRGKTIPRAVVISSLTVTVIYLATAAAVQWIDPGFSANGQLKLAMMLTPLFGSFALPVIAVLTAVLCMCAYFQVTGGAARLVASQAGGLFAYRSRGNQPTAALGLIFLIHTIVFVCLMFHFLNVETLVLIANAFFICNSLCGLAAAYKLLSGRIYKKVCLFLMGGFTLLLLFSSSWVLLFIMLASALFVVNFRQLNIWKKVKRPFKSY

SEQ ID NO: 7251 - protein, 297 aa, Bacillus licheniformis
MEIRHLKTFKTIVDIGGFTRAADYLGYAQSTVTSHVQAIEQELRKPLFYRLGKKMMLTEAGKHLLPYAAEMVELYEKARHIPENDQEPSGNLIIGASESLTVYRLPAILHEFTSKYPQVTVTLKSSTCWQLRDELKQGKIDVAFLLDNDRKENDLHVEKLVNEPMVFIFPKEHPAGQKALDDLTFNANETFLYTEHGCSYRDFFEEYLRQRGVIADHTMEFWSVEAIKQCVMCGLGVSLLPLITTRTDIEEGKLQGTLVRDALFSTQMVYHKNKWLSPAMAAFTDIVRRKAREWEQT

SEQ ID NO: 7252 - protein, 142 aa, Bacillus licheniformis
MGKKEMIMMHFSDFSAVQVRIARPTDRFDEIVAFYEKGLGLKKLGGFSGHHGYNGVMFGLPNVQYHLEFTSHIEGSPCPAPTKDNLLVFYIPDPEEIRSILNRLADMGYDEVPPENPYWKEKGATVEDPDGWRIVLMNTEGI

SEQ ID NO: 7253 - protein, 804 aa, Bacillus licheniformis
MSFDHQTIEKKWQDYWLKNKTFATREDKSKPKFYALDMFPYPSGAGLHVGHPEGYTATDILSRMKRMQGYNVLHPMGWDAFGLPAEQYALDTGNDPAVFTEQNIDNFRRQIRALGFSYDWDREVNTTDPDYYKWTQWIFLKLYEKGLAYVDEVPVNWCPALGTVLANEEVIDGKSERGGHPVERRPMKQWMLKITAYADRLLEDLEELDWPESIKEMQRNWIGRSEGAHVHFAVDGTNETFTVFTTRPDTLFGATYAVLAPEHDLVQKITTPEQKDAVNAYIEEVQSKSDLERTDLAKTKTGVFTGAYAVNPANGEKIPVWIADYVLATYGTGAVMAVPAHDERDHEFASAFGLPIKEVVKGGDVEKEAYTGDGEHIHSDFLNGLDKAAAIEKMIQWLEENGKGEKKVTYRLRDWLFSRQRYWGEPIPIIHWEDGTSTPVPEEELPLILPKTSEIKPSGTGESPLANIKEWVEVTDPETGKKGRRETNTMPQWAGSCWYFLRYIDPKNPNELASPEKLKEWLPVDMYIGGAEHAVLHLLYARFWHKFLYDIGVVPTKEPFKQLYNQGMILGENNEKMSKSKGNVVNPDEIVETHGADTLRLYEMFMGPLDASIAWSTTGLDGARRFLDRVWRLFIDDNGGLNEKIVEGAGETLERVYHETVMKVTDHFEGLRFNTGISQLMVFINEAYKADQLPKEYMEGFVKLLSPVAPHLAEELWNRLGHEETIAYEAWPVYDEAKLVDDEIEIVVQLNGKVKAKLNVPADADKEQLEELAKNNEKVKEQLEGKTIRKVIAVPGKLVNIVAN

SEQ ID NO: 7254 - protein, 107 aa, Bacillus licheniformis
MLHQVLVACLIGGIMGVLGHVKKRGRLEKPRTTKRFIYLGFFEDILVGMVASILLVLSAEPDSGIQLVVLSIIAGYGGEAVLRSFDFVREQQANVQNSERQNKSPHD

SEQ ID NO: 7255 - protein, 393 aa, Bacillus licheniformis
MPRTLWLLVIGMFINVTGASFLWPLNTIYIHQHLGKSLTAAGFVLMLNSGANVLGNLFGGYLFDKIGGFKTVVLGIVITFASLSGLVFFHDWFQYILFLTLAGFGSGIVFPACYAMAGSVWPEGGRKPFNSVYVAQNAGVAVGSALGGIVASFSFTYVFLANAMLYAVFFMIAFFGFKRIRSEKAMQSSVLDHADSVSGKSKFSALLVICTGYLLGWIAYSQWSSTIASHTQELGISLGQYSVLWTVNGALIVFGQPLIGFFVKRFAESLKNQIVIGFVIFMMAYGILFGAERFPAFLAAMVVLTIGEMLVWPAVPTIANRLAPRGKEGFYQGFVNSMATGGRMIGPLFGGMLVDYFSMQLLLAVLLALLLIAIGTAFLYNRKEKQLSAQSDA

SEQ ID NO: 7256 - protein, 274 aa, Bacillus licheniformis
MKKLLKWTSALGLALSLALLAACGNNAASDGKTIKIGATAGPYYDMVKKAIQPELEKKGYKVEVIEFTDYVQPNTALSEGELDANLFQHEVFMKSYNQENNKNLAALISVPTAPMGLYSAKYNDLNDVKSGAEVAVPNDPANAARAFLTLQDQGLIRLKSDVDTLKASVQDIAENPKKLTFKQLESANLPRAVDDLDIAAVPGNFALSANMKLQDALALENMPDRYRNQVVVDEKNKDKPFAKDLKEAVKSKAFEETIDREFAGFGKPKWMTQS

SEQ ID NO: 7257 - protein, 226 aa, Bacillus licheniformis
MESIMLIGFLSFLFSICYLVFHLIRRIFSPGKRFSRKLFYPCFAGGLLLLIISAPYYDEETYAADEKKTENLTTELQELKTEHSALQKEQTALKQQVKQANKKLKAVKAENDTLKKENEKLTKEKDSLTKKTKSLTEKLAKAEEKSGSAETSVKEKSAAAQAEASHSTPAAKKSSAESKQECKIKGSVNHIYHTPGSTYYDRTKNVARWFCTEQEARDAGYRPPKR

SEQ ID NO: 7258 - protein, 443 aa, Bacillus licheniformis
MKFKDQLKFIRRNMRKNRLRVFMTILATTVACAFLIVLASVGFGLQKSMTEQLMKEQIVTEINVVGKEGQSDQKVQKKDLKEFENRKDVSAIIERTNVFAPAEAKLGNRTNNQMSNITITDMAAEQKANIKLDRGRVAKTPNEIVVGYHFGKNLWTKKEAADYEKQMENNAEEAKEPKGYEEDILGKTIELKISKMDEKTGEEGEAKTYDLKVVGVTKKPSYEWASDSTVYVSNGMQKDITGFLKSEKDSGMIEKTLSVYADNFEHVGQLTTDLEDEGYYVDSITKKLDSINLFFMAFKIGLIFVGVIAVFISAIGIFNTMTMAVTERTQEIGIMKAIGASPNVIRKMFLLESAYIGILGSVLGIIISYGVSFLVNKIIPVILSSVSEGEASAAELSITFSHIPVSLVLIATLISAGVAILSGLNPAIKATRTNVLTALRREL

SEQ ID NO: 7259 - protein, 232 aa, Bacillus licheniformis
MISVKHIHHSFKVGKKGRENEIKVLKDVSLTVEKGEIACIVGRSGSGKSTLLNLISGYIAPTKGKIMIDGTDVTKYSEKEWAAFRLEHFGFIFQSFQLIPSLTTFENIELPLTLKGVHPSERKQRVNEMFHRVGLENHAGHYPNELSGGQQQRVSIARALILNPSIILADEPTGSLDSETEQEILEFIRQLNRERGITFVIITHDDEVASIANTKFHLSDGVLEKGEETVEV

SEQ ID NO: 7260 - protein, 325 aa, Bacillus licheniformis
MVDRGLLYKEWKQHFWIFLVVFAAVLLSEPLAILNDYFQYQGCLAEQKKFPDIECVLYKDYGVSGAMRMFWVGGVALAISQIGFERSRGTLDFTLGLPYKRGVIFNTKYFFGISILLTAQLLSYLLSYALIILYNVDVVFFHEYFIGAVIFCFMVYSLVMAAGAMTGNPLAQMIVAFSASILPYLLIGLPLANLRIILGFFGHDPAFFYGETELLDYITPIIYLNSFGIQDGSLAFTLIPLAMGILFYIIGYFCFIKQQLERNGHFFLWRKMDRPIQILVILFGIWGFGTAAASSLFSYIFGMLIGSAVGFLISYFLIFKKIKQL

SEQ ID NO: 7261 - protein, 292 aa, Bacillus licheniformis
MIELKSVSKTIDGKQILKDISFKLEEGEIFGLLGRNGSGKTTLLRLIQQILLPDEGDIFFGSVKVKDHPLVKRNIVYMPVQNTYFEKYNYKQLVNILRNIYPDFDVTYANELMNRYDIPETKKYRELSTGLKKQMSLILSFAIRPAVILLDEPTDGIDAVTRQDVLQLMVDEVAENNTTILITSHRLEDIERMCNRIGFLEDNTLSNIMDLDELKGDFIKIQMAFEEDVNLKIREREIPVLDHTGVFYTVLVPKEDNVSKQFLKSLSPKVWNELPVSLEEVFIAKYGGKRRW

SEQ ID NO: 7262 - protein, 130 aa, Bacillus licheniformis
MIQIDPRSSTPIYEQIIQQMKELCLKGIIKPGDKLPSVRELATIIIANPNTVSKAYKELEREGIIETLRGRGTYISENAKVTLDEGKIAMIKEQLKQLIIDAHYAGIDTKKLQEWMAEIDEEVRGGEVND

SEQ ID NO: 7263 - protein, 90 aa, Bacillus licheniformis
MATRQSVGEHIQRSEDAYDYALSQFETASRQEHYNETEYSDAQLMLENAVNELNKLSLFANEQQREEIHRKRLQLQTLQNNMILQRSYER

SEQ ID NO: 7264 - protein, 322 aa, Bacillus licheniformis
MHQNNPFPYTNSEKRYHTWNYHLRNHFGHKVFKVALDGGFDCPNRDGTVAHGGCTFCSAAGSGDFAGNRADDLITQFNEVRDRMHEKWKDGKYMAYFQAFTNTHAPVSVLREKYETVLGLDGVVGLSIATRPDCLPDDVVEYLAELNERTYLWVELGLQTVHERTADLINRAHDFDCYVEGVNKLRKHGIRVCSHIINGLPLEDRGMMMETAKAVADLDVQGIKIHLLHLLKGTPMVKQYEKGKLTFLSQDEYVQLVCDQLEILPPEMIIHRITGDGPIELMVGPMWSVNKWEVLNAINGELERRGSHQGKWFNKAKEGMAT

SEQ ID NO: 7265 - protein, 194 aa, Bacillus licheniformis
MKLKKILPYAKELLKTAAGEGDIVIDATMGNGHDTHFLAELVGESGHVYAFDIQEAALMNTAERLGNEYKDRVTLIQKSHDELTTSLPDDISGKVAAAVFNLGYLPGGDKSVTTKSDSTIASIKQLLKILKNEGLIVLVVYHGHPEGKREKDALLEFCASLDQDTARVLCYQYLNQRNDPPFIIAIEKKEAVQK

SEQ ID NO: 7266 - protein, 416 aa, Bacillus licheniformis
MKKFIAYQILIALAIGAVIGHFFPDFGMALRPVGDGFIRLIKMIVVPIVFSTIVIGAAGSGSMKKMGSLGIKTIIWFEVITTFVLGLGLLLANVLKPGVGLDLSHLAKKDIDELSGYTEKVVDIKQMILDIIPTNIVDVMARNDLLAVIFFAILFGVAAAGIGKASEPVMKFFESVANIMFKLTQMVMVTAPIGVLALMAASVGQYGIELLLPMLKLVGTVFLGLFLVLFVLFPIVGLVFKIKYFEVLKMIWDLFLIAFSTTSTETVLPQLMDRMEKYGCPKRVVSFVVPSGLSLNCDGSSLYLSVACIFLAQAFNIDMSISQQLLMMLVLVMTSKGIAAVPSGSLVVLLATANAVGLPAEGVAIIAGVDRVMDMARTGVNVPGHAVACIVVSKWEKSFRYNKRFVLEKQYRTESL

SEQ ID NO: 7267 - protein, 359 aa, Bacillus licheniformis
MAVPEHPFGLMAKVYREVFPLVHQELDKWKRKAETIQNPELKTQAKASIRDKTFHCEGGGIMALLSGDKIEQSIRFITAYQTISDYLDNLCDRSTSLDPDDFTMLHQSMKDALTVGAELKNYYRFREDQDDQGYLHDLVKTCQGVLAEIENYDLIKEHLIELCSYYCDLQVHKHVVEHERVPRLEAWFENYKSALPKMEWYEFSACAGSTLGIFCLVSYSVRPDFTESMAGKIRDSYFPYIQGLHILLDYLIDQEEDLIGGDLNFCTYYPSHSDMMERLEYFIEMADEHLRGIPHENFHRLINRGLLGVYLSDDKVAGQKEIGRLAKKLIKASGKTSFFFYINGRAYRKIQKMPWMKSS

SEQ ID NO: 7268 - protein, 259 aa, Bacillus licheniformis
MWCMEAERPVATIVVIHGACEHHGRYKWLSEMWRSSGFNVVMGDLPGQGTSTRERGHIRSFQEYIDEVDKWVARAKAFELPVFMLGHSMGGLIAIEWFKQQQSGIAGLILSSPCLGLQLKPNKFLDLISKGLNVLAPSMRFESGITPDKATRNKEVIEMDINDSLYITKVSVRWYQEMLKALKSAMEPTDAFLNIPLFVMQAGTDWLVDKKMVVKWFNQLASHNKTYREWDGLYHEIFNEPEREDVFKAARAFAEQYIT

SEQ ID NO: 7269 - protein, 172 aa, Bacillus licheniformis
MIYPYKKTEPVIHETAFIADNAVITGDVTIGERSSIWFSSVIRGDVAPVRIGKGVNIQDLSCLHQSPERPLVIEDGVTVGHQVTLHSSVIRKHALIGMGSIILDEAEIGEGAFIGAGSLVPPGKKIPSGHLAFGRPAKVIRPLTDKDKQEMERIRKEYIEKGQYYKSLQKKD

SEQ ID NO: 7270 - protein, 174 aa, Bacillus licheniformis
MNKLMVGIYNFECRIFLGMNRLFHQKTLNRYFRSSTHLGGAMCTISACLSLLLFGSGSVRTAGMASALALLVSHLQVMLIKKLYPRKRPYLTLKETQVLQNPLKDHSFPSGHTTAVFSVITPLMIFFPILALLLIPVGVSVGLSRIYLGLHYPSDVLAGTALGISVGTLSAMIF

SEQ ID NO: 7271 - protein, 378 aa, Bacillus licheniformis
MKIAIFTDTFTPDVNGCARTLKRYTDYLEKNGMPYKVFAPESTHETQFSSRIRRFTSMPFFLYPECRIALPNLIKMKSELREFHPDLIHIATPFNIGLAGLKLAKKWNIPVVGSYHTDFDQYLSYYDLQMFSKLLWKYMLWFHKDFRKVFVPSRETFMQLKAKQFRNLSIWKRGVDCSQFSPAHQTEHIRRRYGIKETYILSYVGRLAPEKDLETLLKIASHPALKDDVHWLIAGDGPLKKELEKRAPLNMTFAGYVKGEELASIYASSDLFVFPSPTETFGNSALEALACGTPVIGADSGGLKDFIQNGRNGFLSEPRNPEAFTANILRVLSNPSLKKRMAYEARSYALTQSWDVIFDNLLSECESVLADLSAEKPA

SEQ ID NO: 7272 - protein, 632 aa, Bacillus licheniformis
MCGFVGVFNHRPSSETAAQEELIKQMNEMIVHRGPDDDGYYHDEHVGFGFRRLSIIDVENGGQPLSYEDDSYWIIFNGEIYNYIELKDELLSKGYEFKTDSDTEVLLATYRHYKQEAASKLRGMFAFLIWDKKEQLLYGARDPFGIKPLYFTKTDGHVYFASERKSLMAVDADLELNEKALQQYTSFQFVPEPETLDKKVQKVESGHQFTVRPGEDIQFKTYWKVQFKPVQTEEDKLVQEVRDAIFDSVKVHMRSDVPVGSFLSGGIDSSFIVSVAKQFHPNLKTFSVGFEHEGFSEVDVAKETADKVGVENFSAIISPEEYMNELPKIVWHLDDPLADPAAIPLYFVAKEAKKQVTVVLSGEGADELFGGYNIYREPLSLKPFERIPSPLKKMLLRVASAMPEGMKGKSFLMRGCTPLEDRYIGNAKIFEEGMKSKLLRQYDSNLSYCDVTKPYFEESRSYSEINKMQYVDIHTWLRGDILLKADKMTMANSLELRVPFLDKVVFEAASKIPEELKTKNGTTKYLLRKAAEGIVPEHVLNRKKLGFPVPIRHWLKNEMHDWAVNIIKESETDAYIHKDYVLQLLEDHCANKADNSRKIWTVLIFMIWHSIFVEKRFVPEELNHQPKEVIIV

SEQ ID NO: 7273 - protein, 400 aa, Bacillus licheniformis
MSKNRRLFTSESVTEGHPDKICDQISDSILDEILKKDPNARVACETSVTTGLVLVSGEITTSTYVDIPKTVRETIKEIGYTRAKYGFDAETCAVLTSIDEQSPDIAMGVDQALEAREGAMSDAEIEAIGAGDQGLMFGFACNETKELMPLPISLAHKLSRRLTEVRKEEILPYLRPDGKTQVTVEYDENNKPIRIDTIVISTQHHPEISLEQIQRNLKEHVINPVVPKELIDENTKYFINPTGRFVIGGPQGDAGLTGRKIIVDTYGGYARHGGGAFSGKDATKVDRSAAYAARYVAKNIVAAGLADSCEVQLAYAIGVAQPVSISIDTFGTGKASEETLIEVVRKNFDLRPAGIIKMLDLRRPIYKQTAAYGHFGRLDLDLPWERTDKADQLKKDALGE

SEQ ID NO: 7274 - protein, 527 aa, Bacillus licheniformis
MNSVDLTTDLQTLLTGENVQMNLSVPHLVEKILERKEGVLTSSGAVRATTGTYTGRSPKDKFIVEEASTKDKIDWGAVNQPISEAAFDRLYAKVLGYLKERDELYVFEGFAGADEKYRLPITVVNEFAWHNLFARQLFIRPEEHDKKPEEQPFTILSAPHFKADPLVDGTRSETFIIVSFEKRTILIGGTEYAGEMKKSIFSIMNFLLPEQNILPMHCSANIGEEGGTALFFGLSGTGKTTLSADPKRKLIGDDEHGWSSTGVFNIEGGCYAKCINLSEEKEPQIYNAIRFGSVLENVVVDSKTGEPDYSDSFYTENTRAAYPIDAIDNIVKPSIAAHPQTIVFLTADAFGVLPPISKLTKEQAMYHFLSGYTSKLAGTERGITTPEATFSTCFGSPFLPLPAHVYAEMLGRKIDEHGVGVFLVNTGWTGGGYGTGERMSLAYTRAMVQAAIEGELDKAEMRTDRIFGLHSPVHVPGVPDQVLDPAKTWTDENEYEEKAIHLAKAFKQNFKKFSNTENIEKAGGPLV

SEQ ID NO: 7275 - protein, 394 aa, Bacillus licheniformis
MKFGLLPRIITAIVLGVIVGSFAPLWFVKTAATFNDIFGSFIKFVIPFIIIAFIIPGIGQIGSGAGKILGITAGIAYTSTIFAGLLAYLVGSNLLPAIISGHQLQEFKNPEEVLQAGFFTIEMTPFMSVMSALIFAFIMGIGIAYLPGKTLKNAFDEFQTIVEKLISYIIIPLLPVHIFGIFTNMTFGGQVQTILSVFAKVFVMIIVLHLVILLIQYSVAGAANGRNPLSLLKIVAPAYFTALGTQSSAATIPVTLRQVRKTGASQKVADFAVPLLANIHLSGSTITLTSCAMGVMILNGQTPTFSVMMPFILMLGVTMVAAPGAPGGAVMAAAGLLQSMLGFNETSVSLMIALYLAQDSLGTATNVTGDGALTMLIHRLTSKKGIGKEENVPA

SEQ ID NO: 7276 - protein, 80 aa, Bacillus licheniformis
MGMPVEFNTMIVTKGKETRVEENVFTLEKEGYRVYPLHVPLEVRKTKRGDITGTAQAERLEWSDGRTHLTYRLVSLNSTN

SEQ ID NO: 7277 - protein, 266 aa, Bacillus licheniformis
MWIEKRRFPSPNKEVRLFSVTYLSQGLKVKGLLAEPAAPGNYDGFLYLRGGIKNVGMVRPGRIVQFASQGFVVLAPFYRGNQGGEGDEDFAGNDREDAFAAFRLLQKHELVKDGRVHIFGFSRGGIMGILTAIEMKAAAASFVSWGGVSDMVMTYRERKDLRRMMKRVIGGTPEKVPEAYEWRTPFDELEKIEAPVLLIHGANDENVSIEHARRLERELLRRNKSVDTWYFSQYTHYFPPRENRRIVRELSQWMKSRPWTSYGKLK

SEQ ID NO: 7278 - protein, 330 aa, Bacillus licheniformis
MKRFFFTILSFIMMLFILASCGGQKTEKIRLAEVTRSVFYTPLYIALSEGFFKEEGLDVELKTTWGGDKTMTALLSNGADIALVGSETSIYVNAQGASDPVINFAQLTQTDGTFLVSRNDSGHFSWDDLKDKTFLGQRKGGMPQMAGEFVLKQKGIDPKKDVDLIQTIDFANIANSFASGTGDYVQLFEPQASIFEREGIGRIVASFGKESGRIPYTTFMAKQSYLTKNKEAVEKFTRAVYKAQQWVETHSAKEAAESIQDYFKDTELSIIASSIERYKQQQSFALDPVLDEKEWNQLQTIMDEAGELPKRTPHQKLVNTKIAEKVTKNY

SEQ ID NO: 7279 - protein, 262 aa, Bacillus licheniformis
MSFLQVQDVTHTYFSLKEKTAALENVSIEVEKGEFVSFLGPSGCGKTTLLSIIAGIVSPTEGRVLVEGRTPDGKDRHIGYMLQQDYLFPWKTIEENVLIGLHISKKLGPETKETALGLLKKFGLYEVEKKYPKELSGGMRQRAALARTLAVDPDILLLDEPFSALDYQTKLNLEDLVFNTLKTYQKTAVLVTHDIGEAIAMSDRILLFSKQPGTIHKTFAVPEPIRKLTPFEARQEPEFQPLFQNIWKELNDLEQQTSETKS

SEQ ID NO: 7280 - protein, 272 aa, Bacillus licheniformis
MNNKHPKPKVDFLHEAFLKEQQAEKRRVRFFQIAIFIVFFSLWETASRLAWIDPLIFSSPSAVWALFLEKMGDGSLPGHIGVTVFETILGFLAGTLLGTFLAALLWWFPRLSKILDPYLVVLNAMPKVALGPILIVAIGPSLTSIIAMGAIISVIITTIVVYTSFQEIDENYLKVMKTFGATKREIFKEVILPASIPTIISTLKVNVGLSWVGVIVGEFLVSAQGLGYMIIYGFQVFNFNLVMLSLLIIAVFATLMYQGVELLERKWMKGRV

SEQ ID NO: 7281 - protein, 158 aa, Bacillus licheniformis
MYEFKDFYRNTVQLSFEKEPFSKEPKHVWVICRYEDQWLLTNHKDRGREFPGGKVEPSENAEEAALREVKEETGAVVRKLTYLGQYKVLGREKVIVKNIYFADIEKIEKQQTYYETNGPVLLKSLPKDIAKNKNYSFIMKDSVLTISLEKLKKAGIIK

SEQ ID NO: 7282 - protein, 107 aa, Bacillus licheniformis
MEKKTYYVSVQDGMISQSSDASPWEFQISATDDDIIILREYFDQLYSEDWVNFFRAHVPAVEYHNDSANDKMDELRKDIYSMLYRLGNEETKSFISENGLAELNSAD

SEQ ID NO: 7283 - protein, 134 aa, Bacillus licheniformis
MFKDLSIFSLFTIGLSAIGFLFGRIEYLFMILITLMGIEFVSKSLNECVEDRFTIKRLFTRLAKKLVTLFLISVAHLFDQMLQTGSSIRDFSIMFYILYEAFQIVSTAHSLGIPVPQMLLDILNTIKEKLRGKP

SEQ ID NO: 7284 - protein, 145 aa, Bacillus licheniformis
MSEKLKATVNKQVANWTVLYVKLHNYHWYVKGKDFFTLHEKFEELYTEAAEHIDDLAERLLAIQGSPVGTMKECLEMSAIKEADGSESAEQMVQNIYNDFLTVAEELKSGMELADEVNDETTGDMLLAIHQSIEKHNWMLKAYLG

SEQ ID NO: 7285 - protein, 147 aa, Bacillus licheniformis
MRFGKWFILLCLAVGLSACSQGDKQAASDEEPKVLTAKLATPESAAKNEKAVIKATVLYGEEPVADADEVEFECWKAGSKEDSELIKAKNEGKGVYSMEKAFPEDGHYKVQVHVTAKKQHTMPVADIKVGKATDETDEDEKEEAHHH

SEQ ID NO: 7286 - protein, 157 aa, Bacillus licheniformis
MPSVESFELDHNAVKAPYVRHCGVHKVGTDGVVNKFDIRFCQPNKQAMKPDTIHTLEHLLAFTIRTYAEKYDHFDIIDISPMGCQTGYYLVVSGEPKVEEIVDLLEDTFKEAVEVTEIPAANEKQCGQAKLHDLEGAKRMMRFWLSQNKEDLLKVFG

SEQ ID NO: 7287 - protein, 75 aa, Bacillus licheniformis
MKTVFLLLIRFYQKWISPALPPTCRFYPTCSNYGLEAIEKHGAFKGGWLTIKRILKCHPFHPGGIDPVPEKKQKD

SEQ ID NO: 7288 - protein, 189 aa, Bacillus licheniformis
MKLLDNILQFNQQFVERQDYQKYQTSKFPDKRMVILSCMDTRLVELLPHAMNMRNGDVKIVKSAGALVAHPFGSIMRSILVAVYELNADEVCVIGHYDCGMSKLSCDSFLDKVVKRGIPKERIETLEYSGVDFEQWLKSFDSVEDSVRDSVSVIRNHPLMPEEVPVHGLVIDPETGRLDLIVNGYPEER

SEQ ID NO: 7289 - protein, 393 aa, Bacillus licheniformis
MKENLIPVTVLSGYLGSGKTTLLQHVLHEAHGLKIAVIVNDMSEINIDGSLVKKGDLIRTDEKLVEMQNGCICCTLRDDLLIEVKKLAENGGIDYILIESSGISEPIPVAQTFTYKDEELNIDLGKYCRLDTMVTVVDGSRFFEDFASGESLLERKQAADETDSREVADLLIEQIEFADVLILNKTDLLNEEEQEKLFWSLRKLNPDCRIISAAFAKVPLSAIMNTKSFDFEKASQSAGWIKELNEEHTPETEEFGISSFVYQKQRPFHPERLKRWLENWPPQIIRAKGFFWLASRNDTAGLLSQAGSSLMIQSAGPWIAASTEEEQKLAFEEDPNLKADWDETYGDRKTEIVFIGIDMNQEDIIRSLDQTLLTDKEMNSDWSALLDSLPEYI

SEQ ID NO: 7290 - protein, 343 aa, Bacillus licheniformis
MKKTFGIASAFILAAGLTAGCSSNGASSEQKENKDTLDIYTTIYPLEDFTKKIGGEYVNVKSVYPPNVEAHTYEPSSKTMAEISDSDAFIYSGVGVEGFADKAVSTLKNSDVKIVKAGEGIDLLSREEEGEHDEHAHGEEHGEHDEHAHEEEHEHGEAEGHDHHHDHGDHDPHAWLDPVLAEKMAENIKDQLVKLEPEHEKTFTKNYESLKKDLEQLDKDFKQTVDKADKKEILVSHAAYGYWEKRYGIKQISVLGLSPTEEPSQKQLENIVKTAKEHNIKYIIFESNVSSKISEIIKKEIGAESLTMKNLESVTKEDIESGKDYTAIMKENLDVLKKALSSK

SEQ ID NO: 7291 - protein, 81 aa, Bacillus licheniformis
MKPNIHPKTYQVIFQDVNSGYRFLSRSTKTSDETAEWEDGKTYPVIKVEVSSDTHPFYTGRQKFNERGGRVEQFKKRFNMD

SEQ ID NO: 7292 - protein, 441 aa, Bacillus licheniformis
MNDLIFARSLFGTTMGFHIIFASLGVGIPLMILLAELIYQRTKDPHYAIMAKRWTKAQAVLLGVAIPTGTIAGTQLALLWPGFMEVIGKVMSLPFQIEIYAFFIEALFMSIYVYAADRLTPLMRITAVIFIVIGAAASAILITNVHAFQGTPEGFKIVNGEITDVQPWTAFFNKSFVATAGHVVVSAFMTGAFIIATIAAYKMLRNRGDDRVYALHRKALLLGLIVGGAFSLVTALSGHESAQLLHRYQPEKLAGAEGLFETQSHAPLAIGGFTDEKTQSVKWAIEIPWALSFLADNRFDTVVKGLNDFPRDEWPPLFIHTLFNGMVFIGSLLIVYAAVGFIWRKVMKKDRFPRWMLAVFITGGPLALLAIELGWVFACTGRQPWVIYHMQKTSEVVTTSGSIGILFLLFFIVYIILGAAVVFVLQYYFKRHPVEEDLKSS

SEQ ID NO: 7293 - protein, 349 aa, Bacillus licheniformis
MQLDGTTDALLAISIVWGFIFIYAVMASMDFGAGFWSMIYMNKKQLKATNIANRYLSPTWEVTNVFIVGIVVALFSFFPGGTFVLGTVLLIPGSIILLLLAIRSGFLVFSHAAKDYERALTYVSGISGFIIPAVLILVLPVTHGNFVYQVDGSHQLDFVNLFLSPHAYSFMGFAIFSTLFLSSLLLADFSNVAGEKDAYQVYRRNALITGPLALLMSFSIMMTMRTEASWLYTKMMDGLPWLILSFLLFLVAFAALFLPNRHNSDRLGKPRLAVIAITLQYFTASYVYGRAHLPYMVYPDVTIQSGFTAPETFRALFISYIVGFIILFPGFYYFWKLFMKDKRYIKQHE

SEQ ID NO: 7294 - protein, 53 aa, Bacillus licheniformis
MEQKILCEVSNCTYWEEGNKCTADAIYVVSHAEGEKASNSEETDCKTFKPEHH

SEQ ID NO: 7295 - protein, 63 aa, Bacillus licheniformis
MNKESLLQAFYQEIHGADETAFQKAARSFMNLWDYEYGCLDGLPDQADRVIGQIVHEDLLLGD

SEQ ID NO: 7296 - protein, 369 aa, Bacillus licheniformis
MIQIKQLTLYHLSMRLKKPFKSSLETFQDRKFIIVEAADQEGVTGWGEVSAFSSPWYTEETTETCYHMLKDFLIPAVLRESFTHPSEVPEALRGFKGNRMAKAGLEAAFWDIYARKKGISLREALGGVKTEVPAGVVVGLAPLDDMLQEIEQYVKEGYQRIKIKIQPGQDIELLKEIRRHFPKVPLMADANSSYELKDISRIKELDAFKLMMIEQPLADDDIVDHRHLQKHIKTSICLDESIRSAADARKAIELGSCKIINIKPSRVGGLTEALKIHDICKEHQMPVWCGGMFETGISRAHNLALSSLPQFLIPGDLSSSSRYWEEDIVKPEIRIEGGYIQVPTLPGMGFEVDTHILRKNSSKIDVFKQ

SEQ ID NO: 7297 - protein, 478 aa, Bacillus licheniformis
MLMDHPNWLKQRAELTPDRMAVIQGDHKLTFIQLFHEAKKTAGRLKSFGLKNGDTAALLLTNRMEMVIAVHACFLLGVRIVLLNTKLSMAERSYQIEHSEAKLLLTEKPFIEEHRGGQPARAVDIEDVQNAACPPVTEIESIHLDDAATIMYTSGTTGRPKGVMQTFANHYFSAVSSALNLGLQEHDRWLIALPLFHISGLSALFKSVIYGMTVVLHQRFDAEEVLRSIKDQQVTIASVVQTMLSRLAAKVDRCPGSLRCLLLGGGPAPLSLLEECKRKRLPVVQSYGMTETCSQIATLAPEYSIEKLGSAGKPLFASSIKIEKNGTECQPGEHGEITVKGPTVMKGYLKNEAANKDSFNDGWFKTGDIGYFDDDGFLYVLDRRSDLIISGGENIYPAEVEAVLLSHPNVAEAGVKGVDDKTWGKVPHAYLVADSPVDEEELSEFCKERLASYKVPKAFHFVDRLPRNASNKLMRHKL

SEQ ID NO: 7298 - protein, 272 aa, Bacillus licheniformis
MTVEWKSERQYEDVLYETYNGIAKITINRPEVHNAFRPKTVSELIDAFAYARDDANIGVIILAGAGDKAFCSGGDQKVRGHGGYVGEDEIPRLNVLDLQRLIRVIPKPVVAMVSGYAIGGGHVLHVVCDLTIAADNAIFGQTGPKVGSFDAGYGSGYLARIVGHKKAREIWYLCRQYNAQEAKEMGLVNTVVPLEKLEEETIKWCEEMLEKSPTALRFLKAAFNADTDGLAGIQQFAGDATLLYYTTDEAKEGRDAFKEKRRPDFGQFPRFP

SEQ ID NO: 7299 - protein, 270 aa, Bacillus licheniformis
MKLTLKDGVSYKIEDNGLSAEKTAVFLHGFTGSAATWDGIDGYFQGMRLIKLNLLGHGGTDSPSDSRRYTTEKQAADLIEIFDRLNVKQAYLIGYSMGGRLALSLAMIHPERVSGLVLESSSPGLDSPEERKARREQDSRLSRRILEEGIKSFVDYWEGIPLFASQLSMDPSKRKKVREERLNNNPIGLRGSLIGMGTGSQPSWWNKLSGINYPVLLIAGSLDQKFVAINESMAKRIPAARLEIVEHTGHAVHVEEPDFFGRIVSEFILK

SEQ ID NO: 7300 - protein, 580 aa, Bacillus licheniformis
MTENPITKYIGNFIDELSLAGVTEAVICPGSRSTPLAILAASHPDINVHIHVDERSAAFFAMGMAKAMRKPVALICTSGTAAANFYPAVIEAHYSRIPLMILTADRPHELREVGAPQAIDQQFLFGNFVKFFTDSALPDSHPDMLAYIRSLAARAAGEAKKAPRGPVHINFPLREPLMPNLEDEPFQRLRSGSHVTVESGRFRADRHELVALSALIKETEKGVIVCGELQDDDAKEHIVALSQAAEYPILADPLSNLRNGTHSKETIIDAYDSLLKEEQLKRELMPELVIRFGAMPVSKPLFQLLKQNPSIRQIVVDPDGGWRDPTQLSAHMLHCTEEEIAVLADSAVNSENRTGNWLEKWRFANSRFRALLRNLEAEDLTFEGNIYRNLQHLIPDNSSVFVGNSMPIRDADTFFENQERTFRIFANRGANGIDGVVSTALGIYAATKEPVTLVIGDLSFYHDLNGLLVSKTLDIPLTVVLVNNDGGGIFSFLPQSAEERYFELLFGTPTGLEFEHAAKLYGGRYICPESSAHFADAYLSSVNRRGLDIIEVKTKRDDRVEQHRRMLDSALHEIRKEWPF

SEQ ID NO: 7301 - protein, 474 aa, Bacillus licheniformis
MVTTVQRTFLKEAPEALNIVKKVNHAVLISYSRKIESIDALSFFINGKEQFAGERFFWSDPDGGLTLVGLGKEISVSTDLKDAGRYQAVHEKWERLKEKTYHFHEDQSRGQAAVGPLLFGGFSFDPLEDRKQHWNGYQEGAFFIPAAMLTQDGEETFITVNRWKTPEEDVRKVLEEIKGAASQLTKADDSRYPEKGHTQYTAKEELDVPEWLEAVRRATDDIKNGKYDKVVLAREILLTFDQPVELHRVLFNLMSEQKTSYIFAIEENGKSFVGASPERLVKKDGENVLSTCLAGSIKRGESEQEDRMLGLELLNDEKNLIEHDIVVNMIHQALLSNCSNIKKPAKPGLYKTKNVQHLYTPIVGKMNAESSIFDLIEKLHPTPALGGAPQQKAIEVIRELEPMSRGWYAAPAGWIDMSGNGEFAVAIRSGLIDSNAARIFAGCGVVADSDPLMEYEETQIKMKPMLSALGGDIR

SEQ ID NO: 7302 - protein, 310 aa, Bacillus licheniformis
MQHQSLSGSVSEIKPEKWRVWWMLTRPHTLTAAFVPVTLGTVMSLESGKIDIWLFLAMLAASILIQIGTNLFNEYFDFVRGLDNENSVGIGGAIVRYGMKPKTVLYLAYGLFGAAVLLGVYICASSSWWLALIGLVCMAVGYLYTGGPFPISYTPFGEIMSGVFMGMVIILISYYIQTGGLTWNVFLISLPITILVGGINLSNNIRDLVGDKENGRKTLPILAGRKNAVQILSWVFAVSYILIGIYIGFEIVSLWSCLVLLSLPKPIKAIQEFKAKEKPAELMVAMKSTAQTNTFFGLLLAIALLIQYVF

SEQ ID NO: 7303 - protein, 251 aa, Bacillus licheniformis
MLTKEQLTKLENELKAGKEQIISRFKENGHFGIDATHPFNSTGDLSAYDNHPGDEGTELYEREKDLALFEHEREHLHDIEHALAMIEKGTYGRCEVCGKDIPYERLSVLPTATTCSEHSSTVSVSKDRPIEEEVLNPPFGHFEQDEDDENVAYDSEDAYQDVERYGNSETPQDLAVPPLSYSQMYMEYEEPLGYVEDYENYAATDITGKDVTVYPTKEHEKYEDLLDEEGIMTSFGDLPAYEKDPYTEDDD

SEQ ID NO: 7304 - protein, 799 aa, Bacillus licheniformis
MFSSKESFKQCFLKRVERLCGKSFRDSSTLDQYQTLGIMVREHISANWIETNERSRSNQNKQTYYLSIEFLLGRLLGQNLLNLGVREIVKEGLTELGICLEDIEEAEMDAGLGNGGLGRLAACFLDSLASLDLPGHGMGIRYKHGFFEQKIVDGHQVELPEQWLKHGYVWEIRNADQAVCVRFGGRVKMAQEGGRLRFWQEDAEVMTAVPHDIPIIGYETKTVNTLRLWNAEPCSLHHEPNILKYKRETEAVSECLYPDDTHDEGKILRLKQQYFLVSASLQSIVKRYKNTHPSLHDFHQKVAIHINDTHPALAVPELMRILLDEEKMTWDEAWHVTVHTISYTNHTTLAEALEKWRIDLIKPLLPRIYMIIEEINERFCGWLWEKYPGEWERIEKLAVIAHGEVKMAHLAIVGSYSVNGVANIHSTILKEREMNDFYSVFPFKFNNKTNGISHRRWLLKANPPLANLITEAIGDRWLKDPESLLDLRPFANDSAFLESFQRIKRERKQLLADMMKGSVGFAVNPDSIFDVQVKRLHAYKRQLLNVLHIMYLYNRLKEDKGFAIYPQTFIFGAKASPTYHYAKKVIKLIHSVADKINHDPDVRHSINVIFLENYRVSTAERIFPASDVSEQISAASKEASGTGNMKFMINGALTIGTHDGANIEMLERVGTECIYTFGLKADEVLDYAEKGGYLSREYYQHDARIRQTADQLINGFFEGEAGEFEPIYDSLIAYNDEYFVLKDFASYIVAQERIQKDYLNKRLWAEKAVTNIAHAGYFSSDRTIREYADDIWEIKPYQH

SEQ ID NO: 7305 - protein, 484 aa, Bacillus licheniformis
MKVLFAVSECVPFVKSGGLADVAGALPKELALLGIETVVMMPKYSLIAEDVRRRMVKTAECEVRVGWRRQFCGIEHLEHDGVSYYFLDHGYYFNRDSLYGHYDDGERFAFFSRAVLEALYALNFEADVIHTHDWHTGMVNYLLKEEYRKKPFYQHMKSVFTIHNLQFQGIFPKEAVHDLLGLDISHFTTEKLEFYGNINYMKGGIIAADQVTTVSPTYRDEILTPYYGERLEGVLSDKKDALTGILNGIDDVLYDPLNDPHIDYHYDAVNRDGKRKNKAVIQKTFGLPVNEDIPLISMVARLTKQKGFDLIKRVLHELFEEEDMQLIVLGTGEAEFENYFRYMEHAFPDRCKAYIGFHEPLSRKIYAASDLFLMPSKFEPCGLGQLIALRYGAVPVVRETGGLHDTVTAYRETTGEGNGFTFAHFNAHDMKHTIKRALSFYHRKEEWGRIVQKAMTHDVSWALSARQYQRLYSREIKGEAHVLK

SEQ ID NO: 7306 - protein, 342 aa, Bacillus licheniformis
MNNQMLGIIDAAVNQHSLQDLTAGRSIGAVPFAGRYRLIDFALSGMVHAGIRSVAVFSKSPYRSLMDHLGSGKEWDLNRKREGLFFLPSSLPHDEHVGLGSFRQFAEHLDYFQRSTQQYAVVANSYTVGHIPFQEVLKQHLESGCDLTEICHEGKPLGMYVTKKSLLWEMVEGHCPEGAQSFEEVCRKERGSLSVNSYEHSGYTAVIDSPESYLFHSLNLIQPVFWEQVFHMGQPVYTKIKNDPPVKYAKNSRVKQSIIANGCVIEGEVENSVLFRGVHVGKGTTIKNSVVMQKTRIGENCRLEHVICDKDVKIGHHIEMSGTMSLPFILKKGAIQGALMNS

SEQ ID NO: 7307 - protein, 379 aa, Bacillus licheniformis
MKEQCVAMLLAGGKGSRLNALTKNLAKPAVPFGGKYRIIDFALSNCANSGIHHVGVLTQYQPLLLNSYIGIGEPWDLDRNDGGVSILSPYAEASEVKWYKGTASAIYENRHFLKELQPEHVLILSGDHIYKMDYGKMLEYHAEKQADATIAVIEVSWAEAGRFGILHTNDKMEITSFEEKPKYPKSNLASMGVYVFKWSVLEDALERDEKNSASSHDFGKDVIPALLEENKRLNAYPFKGYWKDVGTVRSLWEANMDLLGDHPPLDLFERNWRIYSVSPNLPPQFVADLAEIKESLVSEGCTVYGSVTRSVIFQRVAIGRHSAIKRSVVMHDVSIGEYVEIENAIVSAGIRIPDGFCAKPEDGEVLLITEEYVKKHKVV

SEQ ID NO: 7308 - protein, 627 aa, Bacillus licheniformis
MAGVSASDIKAHLFHEGRLYESYRFFGAHQTEQDGRQGFRFCVWAPHAKEVRIAGTFNGWSGVLHRMEKRHQEGIWELFIPGIGEGELYKYEMITAANETKLKADPYAFFSEVRPKTASVTYQLAGYQWGDRKWQKKKQQKAVYEKPISIYELHIGSWKKKADGRFFTYRELSETVIPYVKEHGFTHIELMPLTEHPFDRSWGYQTTGYYSPTSRYGEPHDLMYFIDQCHQHEIGVIMDWVSGHFCKDDHGLYLFDGMPLYEYKHEHDRENWEWGTANFDLGKREVHSFLISNALYWIEMYHIDGFRVDAVANLLYWPNRPQPEANGFAIEFIQTLNEQVFAKDPHFLMIAEDSTDWPLVTHPTYEGGLGFNYKWNMGWMNDVLTYMEASPEQRKHLHHLVSFSLMYAYSENYILPFSHDEVVYRKKSLLHKMPGDYWQKFAQYRLLISYFMMHPGKKLLFMGGEFAQFDEWKDEEELDWFLDDFDMHRKARMFTKEALHLYKKSRILYENDHRQQGFEWIDVNNAEQSIVSFIRYGKQPGEALIIVCNFTPSVYHEYRVGVPFQTEYIEVLNSDDAKYGGSHQINPKRLQARKGVLHGKPYSISMTVPPLGAAVFRAVKKRGAKKG

SEQ ID NO: 7309 - protein, 390 aa, Bacillus licheniformis
MSELTKYSMVKNEIKSWIYEGKVKPGEKIHSENELMKIFDVSRHTIRQAIGDLVHEGLLYREQGSGTYCSHRLQLSEKGRERNKMIGVITTYLSDYIFPSIIRGIESSLSSAGYTLVVASTNNDIEKEKQCLVNMLDKKIDGLIVEPTKTGSFNPNLNYYLTLEQHHIPYLMINQLYQELNPPHFILDDEHGGFIATEHLIKLGHEKVFGFFKQDDMQGVNRMKGFIRAFRENGLSFYPEMVVTYTTENKKEKTIAEARKRLSSADRPTAIFCYNDEIALIVLDVVREFGLKVPDDISIVGYDDSHLSEASEVKLTSVTHPKMQMGIEAAKWMIAKVEGRNTDKLEHSTVYKPELVVRHSTAKPKSRLISFTHTSDSSIRLLSLPTARQK

SEQ ID NO: 7310 - protein, 194 aa, Bacillus licheniformis
MNQSKQLVQLIEIAIMTGIALILDMVSGMFLKMPQGGSIAVMMIPIFLISFRWGLKAGLATGFLAGLLQFVTGGFYVVHPLQLLLDYFIAPTAAGIGGFFAGSIRNASFEKQKGKIISYVMLAVLLGSGLKFLAHVISGAVFFGNYAPKGTPVWIYSLVYNGTYMLPSFIVCTIVLCILLLTAPRLLENRTNMR

SEQ ID NO: 7311 - protein, 185 aa, Bacillus licheniformis
MVACGAYFTTTNVFKLMHGYALFSFQQMKEEEKPEKPPIQTTKKEKTAIDQTFETGEKIGDLVIPKINARLPIYHGTDEDELQKGVGHFAGSVLPGEDDNSVLSGHRDTVFRKLGRVGKGDQLIVEASYGTFTYKVKKVRIVDADDRTVIVPKPRATLTVSTCYPFDFIGSAPERYILVADLIKT

SEQ ID NO: 7312 - protein, 331 aa, Bacillus licheniformis
MKKRLMSLLVCILVLVPAAGAFAAPKQAELKDYLEEIGMTEKELEAYLQDTYDESLKGFDSVEELKDFLGQRLTKKLLASYLKEYGLSEKEAADLFVENGYMESGQNILDVFMFEYELDDALYTVTYEEDDFQIGNMFQELGVDDQEWERLVNHLRKVRDNNPNLENDLMALGERLEAVADFESVSELSAQDIAEMLSILNDLQKTLEVKTKYYLVKDGKKKEVSLTTLVSAEDLKGASLLVEVYDLQGNFILDVLLTPEMIGSDLIHDTGSKVKQTQTAVKHDAKKSHVKKTVKGAKLPKTAGHYAEWSIFGAVLMFGGLFMVRRLRKAA

SEQ ID NO: 7313 - protein, 62 aa, Bacillus licheniformis
MNPYYMMLLCYVLSIIHFLIGYREALKISGADGLVNGTAMISCIPLGAVFAFFAHFFWKMTI

SEQ ID NO: 7314 - protein, 370 aa, Bacillus licheniformis
MAKAVASQEVANMLNDWYILMKKRDISGSIEMKDDIDKAIEKMEEDHDVLLYYQMLDFRLRLLLEDISQSSTEKLEAISFKDKDPKSTDDKLNYYFYLFKGIYEDYKQNHTEALNFFRIAEKRLSVIQNEIEKAEFHYKIGVLYYNLKATWLSIHHINIASGIFQGYDGYAKRVINCKMLIGLNYIDQFKFAESEVLLKEAIEKTEKIGDQYLLPYTYYNMGFLKSKEDKHEEALKYYNKAFAIKDFETKAKYAYLLCVYENTRSLFKTNDPDQAFKWIDTGFKKAQEVNSEIFELKFKTLYTLHSDCQNKLEVIKDFIHQLEDKKAWVDLEELLMDVANYYRENKLYEEAIYFYIKTDKASKLAGRGGE

SEQ ID NO: 7315 - protein, 215 aa, Bacillus licheniformis
MGKKVLLTGFDPFGGETVNPSWEAVKRLNGEEAEGVSIAAEQIPTVFHHSAAVLKKAIEKHKPDVVICAGQAGGRAHITPERIAINIDDARIPDNEDREPIDEPIAADGPAAYWSALPIKLIVKELRKNGIPASVSNSAGTFVCNHLFYQLMHRIDRTSANIRGGFIHIPFLPEQTIDKPEPSLSLETIVEGLRIAAVISALHEKDIRETGGSIS

SEQ ID NO: 7316 - protein, 218 aa, Bacillus licheniformis
MQKSYAVFGLGQFGGSLVKAFHAKGAEVLGIDKSEEKVNEYSTYATYTICANAVDEKTLKQIGIRNIDHAFVSFGDDIEASILTSLLLIEMGVPKVWTKAQNDYHQKVLHKIGVHRIIHPEKDMAKRIASHITSEKMIDFVELSPNYSIVEIVATKKLDKRSLGDIDVRANFGCNIVGIKRDGHFIIAPSADDMIYENDILIVIGQNKDIETFEKKGD

SEQ ID NO: 7317 - protein, 439 aa, Bacillus licheniformis
MKFKQIQLSPSQLLVLVFLFFIILGTLLLKLPAATPKPIGWIDTLFTSTSAMTVTGLAVVDTGTDYTMFGQLIILVLIQLGGLGIMSFAVLIFIMLGKKIGLKERLLIQQSLNQTSLGGIIKLIKSLFIYSFAIEMLAMLILAVKWIPEYGLARGIYYSLFHAVSSFNNAGFSIWPDSLMRYEGDPLVNLVISFLFIVGGIGFTVLSDLWHKRSFKKLSLHSKLMIYGTFIVNLAAMILIFLLEYQNQKTLGMLPLAEKLWGAYFQAVTPRTAGFNTTDIGSLRESTITLLLLLMFVGAGSASTGGGIKLTTFLVILLSVITFLKGKKHISIAKKTLKDQLILRSLAISTISVLLILTAIFILNMTEPIPFLAILFEVVSAFGTVGLSMGITADLSPIGKMLIVFIMFLGKLGPLTLAFSLARPEKENIRYSSEDILTG

SEQ ID NO: 7318 - protein, 304 aa, Bacillus licheniformis
MRTTLYPYIALVVGVLAVSSSAIFVRLSTADAGIIAFYRLFFSALLIFPFFWGKRKEVLGFSKKDWLFSAAAGFFLAFHFILWFRSLEYTSVASSVVLVTLQPIFSFIGTYFLFKERVSFAGIISALLAIGGSVYISWGDFKVSGQALYGDILALLACALVTAYLLFGQHVRKRHSLTVYTFIVYGISALTLCLYCLFSGAAFFSYPASDWGYFFLLAVIPTLLGHSLFNWVLKWLSTNMISVAILFEPVGAVALAYWILDESVMMTQVIGGAVIFSGIILFMASQSIRKNNVPAVKGKTPKAL

SEQ ID NO: 7319 - protein, 160 aa, Bacillus licheniformis
MSIFNEARKELWSEIQGLSDEMLNKRPAEDEWSIQEVIDHLKKIDLMALQILKEQIKHAPVKSIEDKPVHQLEDRSSKRKAPPYAEPERKTADALTLKAELDNVRTQLTSVIAAFHNEDFQRVLPHPIFEELTVRQWLDFIGHHERRHIKQIKEVKQKLL

SEQ ID NO: 7320 - protein, 193 aa, Bacillus licheniformis
MWKKRTAVAEHVYIADTASFVTEKQAKIVIDYGGIPGDLHFGLTKKAGAREPMYKRGTEIFNRRQISIVSVEECLEIAGRLNIPAVLPEWLGANIALSGLPDLTSLREGSRIVFPSGASLLSEGENEPCIQPGEVIQEQFPDKPKLASRFVRHAMGRRGIVCIVERPGLIHQGDQAEVWAYSPAAMKDARSFA

SEQ ID NO: 7321 - protein, 402 aa, Bacillus licheniformis
MTLNMKVEAMNKFHTFEIPTVIKHGIGAVKHVGEEVKKLGVSKALLVTDPGIYKAGVTNPVVVSLQEAGVEVAVFNKVEPNPPVRLVAEGSKLYAEENCDGLVAVGGGSSMDTAKAIGVEATHEGSVLDYEAAEGKKPLENRIPPLTTIPTTAGTGSEVTQWAVITDEEREFKFNTGGPLIAAHLTIIDPELHVSMPPHVTAMTGVDALAHAIECYTMKFAQPITDAVALLAIEYGAHYIRRAFADGEDLEARYGMAQAAMLAGLSYGSESAGAAHAMSQTLGGIIPVAHGQCVAAMMGPVMEYNWKGYPEKFARIAKAFGIDTSGMSAVEAAKAAVNWMYQLVEDLEIPSLEEQGVSPDMIDRLSKEAMKDPQTVGNPRDLNEKAYNWIYKRCFNLTPKTV

SEQ ID NO: 7322 - protein, 498 aa, Bacillus licheniformis
MRNEEAAFMSQTLFIDGKWVGAKKGETRQIINPYNQEHIETVSEGDREDAVRAIAAARRAFDDGEWANTPGLERGNIVLKIAELIRRDHEELAELESLDTGKTIEESRADMDDIANVFQYYAGLADKDGGEVISSPIPDSKSKIVREPVGVCGQITPWNYPLLQASWKIAPALAAGNTIVVKPSEITPLTTIKIFKLMEEAGVPEGVANLVLGPGATVGDELARNKDVDLISFTGGIETGKKIMQAASTNVKKIALELGGKNPNIVFKDADFDVAVDQALNAVFFHAGQVCSAGARLLVEESIQDEFVAELVKRAKKIKLGNGFHEETQSGPLISAEHRSKVEKYVEIGLQEGAKLETGGKRPEDPELANGFFYLPTIFSSCTSDMRIVKEEVFGPVLTVETFKTEEEVVSLANDTIYGLAGAVWSKDIEKAERVASKLRMGTVWINDFHPYFAQAPWGGYKQSGIGRELGRMGLEEYTEVKHVYRNTKPAAVNWFKA

SEQ ID NO: 7323 - protein, 184 aa, Bacillus licheniformis
MDNPRDVSAKETIAQAKDLVIDSIAETMDLYGITRSAGILYGTMYLSDEMTLDEMREELQMSKPSMSTSVKKLQDLNVVKKTFHRGRRKHSFVAEKDFFKFFTSFFPKKWEREVKVNLMAIQDAQKALEDIIESEGLDESIKEEARTLYDQLEHSKPYYDWLLRLAKSVQSGEIFEFIPIDNKK

SEQ ID NO: 7324 - protein, 542 aa, Bacillus licheniformis
MNYAEKKKNWIKLGIFALFAGGILAYIGISNADIHWGGFISMMIFFAFTYYLGAFYAAKKSNSFSDMIVAKRSMPFFVGMVTMAATWVGGGYINGTAESTYSDGLIWAQAPWGYALSLIIGGIFFARKMRRHQFMTIIDPLEQRFGKRMAGVLYIPALLGELFWSAAILTALGTTFGMILNIDFQTSIILSAMIAIAYTVAGGMWAVAFTDVFQMIVILLGLFLVVPFVLSNVGALDSVWANYRHDFGSSANLLPPLDGWKNPDWGNLFWNWWDNALLLIFGGIAWQVYFQRVLSAKSESAAMWQSIIAGVICIIAAIPCVIIGAAGNSTDWSLFGASAPDNPAMILPQTLAYLTPGIIAGLGLGAIAAAVMSSMDSSILSASSMAAWNIYRPLIKPKATQKQLQKVVKRSIILFGAGAAVIALNVKSVYTLWYLASDLVYCILFPQLTMALFYKRANLYGSIAGFAVAVILRLGGGEPAFGIPPLLPYPMIEDGTVLFPFRTLAAVTAFMTIFAVSELTQRKCPPKQLVLPQEKQKDDRAA

SEQ ID NO: 7325 - protein, 305 aa, Bacillus licheniformis
MKKDESSITSLISAFGRAYHSQYDEPKIFDDNLAKSLISQQEFADIKNSFIQGIQFFNKAIAEKYEGDDEEILRWITQVQLSPTPLARAAYCERVLHHEIRLGTEQYVILGAGLDTFCFRNLELKDKIDIFEIDHPATQKLKKEKLDKAGFHIPDHLHFIPLDFAKSFSYQELADKGFHFNKKTFFSFLGVSYYLTKEETEKLLGELMADLPSGSSIVFDYADENLFKEKGFFNRVENMVKMAAAGGEPMKSCYSYQKIQHMLQQSGLLVYEHLSPSDIQGRYFKNRKDDLSAFETIHYILAVKK

SEQ ID NO: 7326 - protein, 393 aa, Bacillus licheniformis
MKKLCREVWVEVNLDAIKKNLRAFRRHIPKKSKIMAVVKANAYGHGSVEVARHALEHGASELAVASVEEAVVLRKAGIKAPILVLGFTPLSCVKEAAAWNISLSAFQVDWIKEANEILENEADPNRLAVHINVDTGMGRLGVRTKEKLLAIVEALTASENLEWEGIFTHFSTADEPDTELTMIQHEKFISFLRFLKEQGFKLPTVHMNNTAAAIAFPEFSADMIRLGIGMYGLYPSDYIRQLNLVKLVPALSLKARIAYVKTMLTEPRTVSYGATYVAERGEVIATIPVGYADGYSRELSNRGFILHRGRRVPVAGRVTMDMIMVSLGEGEGKQGEEVVIYGRQKGAEISVDEIAEMLDTINYEVVSTISWRVPRFYIRDGEIFKKSTPLLYV

SEQ ID NO: 7327 - protein, 358 aa, Bacillus licheniformis
MKRTAGTPAWYNHVPHPIRNDGAGATDFGPRDVMRDLENPDMFVPPKTDAGAIPNLKFSFSDTHMQLNHGGWSREITARELPVSTTIAGVNMRLTPGGVRELHWHKQSEWAYMILGHARITAVDQEGRNFIADVGPGDLWFFPAGIPHSIQGLEDGCEFLLVFDDGNFSEFDTFTITDWFAHTPKDVLAANFGVHESAFARIPDKQRYIFQAKVPGPLENQKVPDPYGTVPKSFAYRLFAQKPIVTPGGTVRIVDSSNFPISTAIAAALVEVKPGGMREMHWHPNNDEWQYYISGTGRMTVFAANETARTFNYRAGDVGYVPFAMGHYIQNTGSESLWFLEIFKSSRFADISLNQWMA

SEQ ID NO: 7328 - protein, 132 aa, Bacillus licheniformis
MRNGVWALYNDKEYEIIQHDQENYELFTKDPEAIQFGFILDETGHYCKQVRREHISSVYDVRYQAIINDLEFPVFREEDNRLLIGSGLHGPDIIKKYGFVQVDRFEYEKWVGKSEVEKIEEVKVPMWGFPAP

SEQ ID NO: 7329 - protein, 640 aa, Bacillus licheniformis
MDVKYVPEEWQGMKDGLDALTGGQYGGGMKSGLIKLNDLLEDIESKIKDKDSDRSISFTHTSKKSKIEELFKDYQKLADFCLKAGSLVADHIDSPFYKKIDAFAEKMRGLTIHNYTTVNRIGSKETTYVGYGMSKQAVETDKAKVSVNDIFKDSESFDHVLSKEFEEFQINHPDIELSYEEYTKAIASSRGFEYESIGDVQKNQELWRDLLAGAGIIVLTIFCAPAGLTVAVAYGGANIASAATGKDWMTQRELNTGERFERGVFGALDIIPGAAAAKGSFKSAATIGQISSKTEHMVQSLKDSKNIWANRMKVNGLKAQDRLNDAGFAIKKQFAKSADALSDIARGAEAGAGGTLVRKGSNYSAHVNDAHKASKAKMQDSIQRVEKEIEAGKSVKSVVKEVDVNRNSPVNPKFSWEQLDKSFEDNLGTVLKKHKLTVNNFNDLRLKSINKLSSKEVEVIKDIRRNVPSLSEDTIMQKVLSPDSKSWLFSSPSDGGQIKLGGYVARATDTKELNTFDKIYEGLRLDYENNPFSGGTSALAVRYKAGNPNDYKIPFGGKNSEAVNKMTHDDLAMDYIATEQQSPFTGNGFTESKDYTIPEYRNDTRTPMHEGAELYEITNQGEKLIGIYSVKQKRFISVNE

SEQ ID NO: 7330 - protein, 107 aa, Bacillus licheniformis
MNAEGGAGGGGTNIHLEFEEMITISNKLKSICDIYTEGVQKEIKNLSESDFYKAGQASKAIESYADILGKTMELFDNYCIASHIVSYAMEKMYETDKELQKLYKIQK

SEQ ID NO: 7331 - protein, 221 aa, Bacillus licheniformis
MQVKADTLSAAELYVLAGAAGVSYIFGLPEREQLALVEPDCAIKAKDSLIEKGILLKEGKLTKTAFFLIKLLQHYQESGEYVRFNNVMCAFLPDDEERVIALTEISPGKGYTLDYVEKREVYLSLISKVSFLVREPRDQDRAFLTKPMSAAEKAEVRAMNLDEKEVLAVETFKLASQQKPADPGFQTTTLYFTKGEDFISVDPLNDRYEWISLLYHEQPDL

SEQ ID NO: 7332 - protein, 116 aa, Bacillus licheniformis
MDGYGYYNYQAANPKVSGETVKISHNGTIKAHSHAKAIEKHVGDSLKKAKELKAYVESGKWSGKTRDAFLSYLELIIELNADMKDALKEHTAALDALEKHIDGFSQLSEVQEIKNL

SEQ ID NO: 7333 - protein, 119 aa, Bacillus licheniformis
MSEGFWDSVGNFLHISYTENERKRDEYKNLYDYLSDKESDVKTKLAEIDASLKAYHSNLPDLKIPSHEFEDTRHEKDAKLKELVKHFKDMVDDIQSAKTKAKSKWEYYKAKAEAEEKKA

SEQ ID NO: 7334 - protein, 69 aa, Bacillus licheniformis
MREHKGCIKCGSTDAGQKEIATTGTGLSKLFDVQHNRFLVVYCKNCGYSELYNKQSSTAGNILDLFFGG

SEQ ID NO: 7335 - protein, 57 aa, Bacillus licheniformis
MGEKYGSLIAIFILALCVHSNIVVEHALLQTIIKAVSLFVMIASALAAFVKGIRQPS

SEQ ID NO: 7336 - protein, 493 aa, Bacillus licheniformis
MSESSKKSVVMLLIDSLMDEPLKEAVKNGQAPGLQYLLENGRYVPDMISPFPTMSVNVDSTLLTGVYSDQHKVPGLVWYNAKEKRIINYGSHIRELLKLGIKQSSRDVFYNLNQVHLSQQVKTLHEELDEKGIETCSINALLHRGSRDGYLQIPFLFSMISGLNRSVKINASQLFSYGGFSKVNPANRSLFKKFGFNDRFSTNELVYLIQTNKVPPLALVYFPDLDQHVHKHGRNDAAGVAKADRHVQRILDSFSSWEAALKDHIWIVMGDNGQAWISGNKKEALIDLRSLLDAFRIVKLKKGVTADDDIVLAVNERMAFIYSLDKAKLPLKRIADILQKDERIDIICWKNEADSIEAVSGEQHGKLTFRPGGKCTDEFGQTWTLEGDLHILDLTVEQNSLTYGKFPDALARLYASFFSHEGDYLIANAKPGYEFIGEGSPTHVGGASHGALHKQDTLVSMIITGTDTMPAYNRLVDIKEWILDLVKSRGAGE

SEQ ID NO: 7337 - protein, 377 aa, Bacillus licheniformis
MTKILIFPFLSISTGHHHVADSLQTELLLKSHHCEKIDIFSHAYRRLEKASSAAYLSWIQYFPKVYSSVYHLLACGRHETAKRHLLYELIFLKGMQQIIAEKKPDIVFCTHALPSYLLNRLKGQFPDMKVANVYTDFFVNRIWGREKIDYHFAPIKDIKDQLIAEGVDEEKIFLTGIPVHRSYKTERKPEQDGDKKAFCNILITGGSMGVGGIFKLVRELSPNGNVAYQILCGKNRKLYRYVRDLNNPYIKALPYIESKTEMNRLYAEASGIITKPGGVTISECIEKQLPVFIYHALPGQEEMNLDILKKKNLVIELNQQKQQPIEQQLLSFFRSDEDIRRYQMSVDQYLREKSDRDFSDILDGIIHNRSGLGNAHV

SEQ ID NO: 7338 - protein, 182 aa, Bacillus licheniformis
MRNCFLSIWSVIDPFYYFFSRLTLIDQTKTSIFRVRLTKYKGIDVVLSDGTVIKKNDVLIKIHLHNIKLIKELQNIESAVGRGILIYQKAYFSMPILAEYIKNHHRSDQIKGIIGITTLHKGVERLGFEAVEPANQFYRVFKKLTQIPILYLTTKQFSLRKIPPSQYLFISKEKLFKSYLQK

SEQ ID NO: 7339 - protein, 271 aa, Bacillus licheniformis
MFIIACLLIILGLMPFLYKANHNTKDVKVNTISVERVQAPALKKKLNILHLSDLHLENISISPERILELANKKRVDLIALTGDFLDRKRNIPKLANYLKALKKLKPAYGMYAVFGNHDYLLKDEHFRKLKRVLEDNGCITLQNQHVSIEVEGETLNIIGIDDYSTKRSDIAGSYKGLKEGYNLVLTHDPNVVLDMQEFHFDYLLSGHFHGGQIHWPKPYHLVKMGKLVRMNMIKGLHYHHDKPFYISEGLGQTGANIRIGSRPEMTFHHIS

SEQ ID NO: 7340 - protein, 276 aa, Bacillus licheniformis
MNIWDIIVAIILGIVEGLTEYAPVSSTGHMIIVDDVWLKSKELLTPEAANTFKVVIQLGSILAVAFVFKDRILNLLGMKKNITEEQKSGNRLSIAQIAVGLVPAAVLGFLFEDYIDQYLFSVRTVAVGLIAGAVLMLAADWINRRKDTTDSVDRMTYKQALGMGLFQCLALWPGFSRSGSTISGGVILGLSHRAAADFTFIMAIPIMMGASLLSLIKNWAYLSADLLPFFIAGFISAFIVALFVVRFFLRLINKIKLVPFAIYRIVLGLLLFILFL

SEQ ID NO: 7341 - protein, 381 aa, Bacillus licheniformis
MDSLHMWGGRFKKFFLDNKFVLFLLILLLIGLNILVFTKASFIFTPFIVLVETIALPVVLTGVVYYLLNPIVDFLEWKNVKRIYSILLLYIVIIGLITISIVSVIPLLREQITSLVDNFPRYVHIVEDQIKQLIGSQFFNQVQQTMNINLTDLASKLSDQATTILNSTFTGVGTFIGAVTEVVISIVTVPFILFYLLKDGKKLPLFILKLIPVRLREQTYVMMSEMNHRLSSYIRGQIIVSFCIGCLLFIGYMIIGLDYASLLALVAACTSIVPYLGPTIAITPAIIIALVTSPFMLVKLIIVWTVVQLFEGKFISPQIMGKNLHIHPVTIIFVLLTAAKLFGVIGVILAIPGYAVIKVVVTHLFEWFKQRSHLYEKNEEV

SEQ ID NO: 7342 - protein, 328 aa, Bacillus licheniformis
MMRFGVVGTNWITDRFLGAARLIEDFQLTAVYSRTGERGREFAQKYGAEAVFTDIGEMAESDVIDAVYIASPNSLHKDQAVTFMKSGKHVLCEKPLASHVKEAEEMVKTAQEHRVTFMEAMKTTFLPNFKNISRNLHKIGKVRRFTASYCQYSSRYDAYRNGTVLNAFNPALSNGSLMDIGVYCVHPAIVLFGKPLEVKANGLILESGADGEGTVLLKYKEHEAVLMHSKISNSFIPAEIQGEEGSIVIDKIHRPEQVDIRYRDGRVEHLTLPDDKPAMFYETEEFINLIKQGRIESSLNTFERSIDTLAVIDEARKQIGLVFPADHM

SEQ ID NO: 7343 - protein, 174 aa, Bacillus licheniformis
MRLEGKKVIALVSDEFEDLELWYPVLRLKEEGAIVHFIGEKADHEYKGKYGVPAVSDYELKSVNIEEYDAVLVPGGWAPDKLRRYPEVLEMIRWFNERKKPIGQICHAGWVLISAGILEGRKVTSTPGIKDDMENAGAIWVNEAAVVDGHIVSSRRPPDLPIYVKAFADLLAQS

SEQ ID NO: 7344 - protein, 660 aa, Bacillus licheniformis
MSKIVNWVKRPSIAKKLILSFLLILTVPIIVLSYSAYQTASSTLDGEIMDNARENVNQLNEIINQNISQKTNAMSYFSGFIKENSFTGKESDALKVKFEQFAKLHPDVEGIFTGSKDGKFIRYPDQKMPSGYNPVERDWYKKAAEHKGEVVITDPYKTASTGTVVITIAKMHEDGSGVVAVNMKIEELIKATERVTIGKKGFAFITSADKKFVAHPKHDAGTDVEGSWAEKVYANDKGTFKYTLDGEKQMAFATNKLTGWKIGGTMYITELKEASQPVLNAALITLGASIIIGVLLMILIIRSITGPLRELVSSAKSISGGDLTQKITVRSKDEIGQLGTSFNDMAESLSSLISVIQTSVENVASSSEQLTASADQTSKATEHITSAIEQFSNGNESQNEKVEISAQQLTDMNSRLHEMSKVSASITESSIQSTDIAGTGGELVQKTVGQMNSIDHSVKQAESVVKGLESKSKDITAILRVINGIADQTNLLALNAAIEAARAGEAGRGFSVVAEEVRKLAEQSASSAKEIEALIQEIVNEIGKSLDMFRDVNREVQSGLTITDETDTSFKQIYDMTNEIAGKLQTMNAAVEELSEGSQQVAGAVEEIADVSRESSGSIQDIAASAEEQLASMEEISSSAATLEQMAEELRDLTKKFKID

SEQ ID NO: 7345 - protein, 661 aa, Bacillus licheniformis
MKKILDWLKRPSISKRLFFSFILVLTLPILALSYSAYQTAGSSLETEIMRSARDNVEQLNEIIDQNIGEKEEAVSFFSGLVNEKLYQEKENASLVERLEQYAKLNQDVEAIYTGSKDGKFIRYPAEKMAKGYNPADRDWYKQAVENKGKVIITNPYKTASTGTMVITIAKQTEDGSGVVAVNMKIDELIKATERVNIGKSGFAFISSNDKKYVAHPTIEAGTEGKGDWVGQMYGSEKGDFQYTFEGKEKKMAFTTNKLTGWKIGGTMFTDEISEAAQPVFHMAIIILAAAIVLGGILIYFIIRGISKPLSELVSSAKSISGGDLTQKIEVRSKDEFGQLGTSFNEMAESLRSLISVIQSSVDNVASSSEELHASAAQTSKATEHITMAIEQFSDGNESQKEKVEASSHQLNEMNNGLYDMSKTSAAITDASLKSTEIAGKGEELVQKTVGQMNSIDRSVKQAEAVVKGLEAKSKDITSILRVINGIADQTNLLALNAAIEAARAGESGRGFSVVAEEVRKLAAQSADSAKEIEHLIQEIVKEIDNSLNMFKSVNHEVQSGLRITDETETSFKTIYDMTNDIAGKLQTMNAAVEQLTQGSRQVAGAVEEIADVSRESSASIQDIAASAEEQLASMEEISASSTTLAELAEELRDLTQKFKIE

SEQ ID NO: 7346 - protein, 660 aa, Bacillus licheniformis
MKKLLNWTKRPSISKKLIFSFIFILTIPILVLSVTSYFTASSTLEDEILRSAKDNIDELNDIIQQDIGSKETSIAYFSEWIDQKAYKEKGQTAIKQRFEQFAKQNPDVELVFTGSEDSVYAQYPNAPLPDGYDPVERDWYKQAVQEKGKTIVTEPYESASTGHMVVTIAKQNKDGSGVVALDLNIDKLIKSANSISIGKTGYAFIIGEGKTYVAHPKIKAGTEAEADLTEQMFSKESGLFTFNEKGKEKKTVFTTNKLTGWKIGGKMNTAEIKDAAQPVLHMAVMTLAGAIILGGILVYFIVRAISKPLNQLVSSAKSISEGDLTQKIDVRSKDEFGQLGTSFNEMADSLRSLISTIQESVDNVASSSEQLTASADQTSKATEHITLAIERFSSGAESQSEKVEESSQRLSQMNEKLNEIAGVSESITESSGKSTEIAETGGELVQQTVGQMNSINRSVKQAEQVVKGLEAKSKDITAILRVINGIADQTNLLALNAAIEAARAGESGRGFSVVAEEVRKLAAQSAGSAKEIEALIQDIVKEIEHSLNMFKSVNQEVQSGLEITEETESSFKHIYDMTNEIAGKLQTMNAAVEHLSTGSHEISDAVEEIADVSRESSAGIQDIAASAEEQLASMEEISSSAATLEQMAEELRDLTKKFKI

SEQ ID NO: 7347 - protein, 245 aa, Bacillus licheniformis
MISVSGYRLRPEDIEKLNVSQTQRDIANRMLAMPSGYRYGSISELLFELRFREHTVKSARELINSGAKFATFSKTYGNEEFWRVTPEGALELKYRAPASKAIRNIFESGPSYAFECATAIVIIFYMALLKTIGDQTFDRNYQRIILYDWHYERLPIYTDKGNDYLPGDCLYFKNPEFDPSRPQWRGENAILLENNLYAAHGLGILSGETIIEKLNGLRKPHAQTSAYLLSQVTRVDIPALIQMIR

SEQ ID NO: 7348 - protein, 351 aa, Bacillus licheniformis
MNQFMERLSLSKPVVQAPMAGGPTTPRLAAAVSDCGGLGSLASGYLTPEVLQQQILETKKLTSAGFQVNLFIPEKRETVTREEYERWQEKIPLARSASPVTDEKQDWDDFYEKIEIILKEGISAVSFTFGPPPADAVKELKNRNCCLMGTAVSVEEAVLLEELGMDVIIVQGSEAGGHRGAFLKTKGEPAVGSMALIPQAADHVSVPVIAAGGIFDKRGVAAAFALGAQGVQIGTAFLTCEESGTHPAYKQKLFEAVETDTSLTRLFSGKPARGIVNQWMEDRRQEEAEALPYPLQNTLTQPMRKQAKLDGNTDNMSLWAGQSVRATVEQTTVKELMDQLVPADVLSDHLN

SEQ ID NO: 7349 - protein, 133 aa, Bacillus licheniformis
MLKKIQIQTNRRDEMLDITNDVQRFISENDVSSGAVIVYCPHTTAGITINENADPDVKRDMLRRFDEVYPWEHELDRHMEGNTAAHLKASTVGASQHMIIEGGRLVLGTWQGIYFCEFDGPRHRTCYFKILAD

SEQ ID NO: 7350 - protein, 560 aa, Bacillus licheniformis
MARAWWKEAVVYQVYPRSFMDSNGDGVGDINGIREKLPYIRELGADAIWICPVFDSPNADNGYDIRDYQSIMPEFGTMDDFDELLTEAHQLGMKLIIDLVINHTSDEHPWFIESRAERNSGKRDWYIWHDGKDGSEPNNWESIFGGSAWTYDEKTEQYYLHLFHEKQPDLNWENSDMRSALYDMINWWLQKGIDGFRVDAISHIKKKEGLPDLPNPEGRPFVPSFAYHMNVEGIMALLQDVKENTFAGYPHIMTVGEANGVSAEEAEDWVGEPNGIFSMIFQFEHLGLWDIEGGEPDIPELKRILSNWQSALEGKGWNALFIENHDQPRAVSVWGDDGKYRTVSAKALAAMYFLMKGTPFIYQGQEIGMTNAIFLDIDDYDDVSIKNYYRIQKEKGRSHEDIMKAVWKKSRDHARTPMQWTDRPNAGFTKGEPWLRMNENYKLINVVHQQHDPRSVYHFYKRLIAIRKRYDVFIDGSYKLLLAEDRQIFAYLRKLEEETAIVIVNLSARQAFYHHPAYPLCSNGLLLSNLDINAHKHLTSFMMRPYEARVYLIRQEIGDL

SEQ ID NO: 7351 - protein, 196 aa, Bacillus licheniformis
MKKKMNTQDAIVEAAFTLIARHGLKGTSLSMIASEVGISKPAIYYYFPSKEELIDYLFHIVFDDHNFSEYFSINKYTKENFKKRLITDGVRYFEEYKHNSPALKVVHEFVLSAAQKPRYEKKLKSIMEQFLEGFEALLSYGVELGVISSKNTKVNAHSLALIIDNLGNFMILGIEMDYKKVWETAVSNVMKGSERF

SEQ ID NO: 7352 - protein, 224 aa, Bacillus licheniformis
MNQETIIGLSKIEKTLYWIIPPVLGAVLGWFLPVIADWVLTIPIVPFKGPLEFITSLNSFWVSIIAAFIGIVAGLFFSQYIFTEILQVFISDQNVKLLFKEKEEVIEKKDISAIYLEKKDLVVLGHKGTELYREQLESKRALAESAFKHHGYKWADEDPFKNEYQRWVADHPDFPSHINTLLLARERALLDNKHEEAKILRKDLAKLGVVIQDEDKRQYVRMVS

SEQ ID NO: 7353 - protein, 261 aa, Bacillus licheniformis
MKNNHLLKSILLWGAVCIIVLAGPLSAFAASSSNPSDKLYFKNKKYYIFNNVWGADQVSGWWQTIYHNSDSDMGWVWNWPSNTSTVKAYPSIVSGWHWTEGYTAGSGFPTRLSDQKNINTKVSYSISANGTYNAAYDIWLHNTNKASWDSAPTDEIMIWLNNTNAGPAGSYVETVSIGGHSWKVYKGYIDAGGGKGWNVFSFIRTANTQSANLNIRDFTNYLADSKQWLSKTKYVSSVEFGTEVFGGTGQINISNWDVTVR

SEQ ID NO: 7354 - protein, 429 aa, Bacillus licheniformis
MNILNLILVILLIAATAFFVVAEFAIVKIRGTKIDQLVESGDKRAIAAKRVVTNLDEYLSACQLGITITALGLGWLGESTFEQIIHPLFELFGLPESVLRVASVVAAFIIITFLHVVVGELAPKTIAIQKAEAVSLWTAKPLILFYKIMFPFIKLLNGSARLLTKLFGFHSVKEHEVAISEEELRLMLSESYKKGEINQSEYKYVNKIFEFDNRLAREIMVPRTEMATLMADQSIKEAIETVINERYTRYPVIKDDKDHIIGIVNSKDLFKSYFLDETIPLTDLMRPVIRVIENIPIQELLIRMQKERIHMAILVDEYGGTAGLVTVEDILEEIVGEIRDEFDQDEMPHIIKKGEHHYIMDGKALIDEVNDLLHIAIENEEVDTIAGWLLTQKMELKNGDILKTEGCEFKILDAEDHHIRFIEVKKTDF

SEQ ID NO: 7355 - protein, 226 aa, Bacillus licheniformis
MSMIFYLLTFAALGLSIWAQFKVKSNFEKYSKVEASSGRTGAEVARQILDRNGLYDVPVEPVRGTLTDHYDPTARVVRLSEPVYYGRSIAAVSVASHECGHALQHQESYGALVLRHKMFPVVNFSSGVAPFLFIGGMLLGSLNLIGLGIILFSAAVFFQLVTLPVEFNASSRAKRIIVSEGMIRNTEERGVSKVLDAAALTYVAAALVSLFELLRFVAIFLSGRND

SEQ ID NO: 7356 - protein, 84 aa, Bacillus licheniformis
MKVTDQEKEQLSTAIDKMNEGLDAFILLYNESEKDEQLIEFEEETAEMIRQAIEQHGKVSTNQKLNAIIKEILSFSLRKDGEEA

SEQ ID NO: 7357 - protein, 134 aa, Bacillus licheniformis
MISLPSELENRSFSLYHLEQTLKPLGYVISGGWEYDRGFFDYKIDDEDGYLFLRIPFEAEDGQLDSQNATVKLGTPFLLRHVYQEALDDYVVQGNFRASFDQFAEPKEKDADIPGVYEKLGQSYVKELEEALLS

SEQ ID NO: 7358 - protein, 188 aa, Bacillus licheniformis
MAFVLETLFLILTGIVLLRISGRKSISQMTIATTVVMISIGTIIVQPIIEDSIFKTVAAASIFIIVLLLIEYLKMKFDFFESLIAGKAVVLIENGELQEQNLKKHRLTVDQLEMRLRTQGISKLADVKNVTLESNGQIGYELSDDAKPFTMGEYKKFLRMQNNLQQPEDNLFKEITEGHLNEPDKQLR

SEQ ID NO: 7359 - protein, 158 aa, Bacillus licheniformis
MKKGKIVTAVIVFLVIYALFSLAGILFPVDREWYESLNKPDWTPSGRLIGTVWSVLFAFISLAAALVYAAYDMRKAAAPFWIMLIINYVFNQAFSYFQFTQKNLLAAAVDSFFVAITALSLTFITRRIHKTAAILFIPYVLWSFFAAYLAFTIYGMNH

SEQ ID NO: 7360 - protein, 169 aa, Bacillus licheniformis
MNHFLQTKRIGFSLWKKENLNLAKTLWGNRDVTNYLTADGIMTEGEIRNRLLLEIEQYKTHGVLKTSNNEFVGCCGLRPYDPENDVYELGFHLVRSAWGKGYASEAAEAMIEYAFNKIRAKKLFAGHHPENTASRKRLEKLGFVYIHDEFYPSTGLQHPSYELKQPPGQ

SEQ ID NO: 7361 - protein, 450 aa, Bacillus licheniformis
MTHVRFDYSRALPFFKEQELTYLRDFVKVAHHTIHEKTGAGSDFLGWVDLPTDYDKEEFARIKKCAEKIQNDSDVLLVVGIGGSYLGARAAIEMLNHSFYNVLPKEKRKTPQVIFIGNNISSSYMRDVMDLLEDADFSINVISKSGTTTEPAIAFRIFRKLLEEKYGKEEAKRRIYATTDKERGALKTLANEEGFESFIIPDDVGGRFSVLTAVGLLPIAVSGADIDEMMKGARDASKDFSTSELEDNPAYQYAVVRNVLYNKGKTIEMLINYEPGLQYFAEWWKQLFGESEGKDEKGIYPSSANFSTDLHSLGQYVQEGRRDMFETVLNVEKPRHELTIEEADNDLDGLNYLAGKTVDFVNKKAFQGTMLAHTDGNVPNLIVNVPEMNAYTFGYLVYFFEKACAMSGYLLGVNPFDQPGVEAYKVNMFALLGKPGFEEKKAELEKRLNQ

SEQ ID NO: 7362 - protein, 387 aa, Bacillus licheniformis
MDNFTYWNPTKLIFGRGEVEKLAEEVKQYGRNVLLVYGGGSIKRNGLYDQVISILEKAGATVHELPGVEPNPRVATVNKGVAICKENDIDFLLAVGGGSVIDCTKAIAAGAKYDGDAWDIVTKKHIPADALPFGTVLTLAATGSEMNSGSVITNWETNEKYGWGSPLVFPKFSILDPVNTFTVPKDHTIYGIVDMMSHVFEQYFHHTENTPYQDRMCESLLKTVIETAPKLIEDLENYELRETILYTGTIALNGMLSMGARGDWATHNIEHAVSAVYDIPHAGGLAILFPNWMKHTLSENVGRFKQLAVRVFDVDETGKTDREVALVGIEKLSEFWTSLGAPNRLADYDITDEKLDLIADKAMANGEFGRFKTLNKDDVLSILKASL

SEQ ID NO: 7363 - protein, 78 aa, Bacillus licheniformis
MNALQRIALVLTIIGAINWGLIGFFQFDLVAAIFGGQGSALARTVYALVGIAGLINLGLLFKPAEETAGEDAKQPEMR

SEQ ID NO: 7364 - protein, 129 aa, Bacillus licheniformis
MTAKFEVGSVYTGKVTGLQAYGAFVALDEETQGLVHISEVTHGFVKDINEHLAVGDEVQVKVLSVDEEKGKISLSIRATQAAPERKESKPRRQKAVQAEDTAAPQGFNTLKDKLEEWIEQSNRKDLIKK

SEQ ID NO: 7365 - protein, 390 aa, Bacillus licheniformis
MRTTYISKAAQQIKPSGIRKFFDLASTMEGVISLGVGEPDFVTAWNVREASILSLEQGYTSYTANAGLLSLRKEISAYLNKRFHLDYAPDDELIVTVGASQALDIAVRAILDPGEEVLIPEPCFVAYEALVSLAGGKAVHIHTNAERGFKASAADFEAVLTERTKAIILCTPSNPTGSVYSKKELEEIAAFAEKHDLIVIADEIYAELTYDEAYTSFAEIAGMKKRTILISGFSKGFAMTGWRLGYVAAPAYLRDPMLKIHQYSMMCAPSMAQFAAEEALKNGLEDVEKMKKSYRRRRNVFVDSLNEIGLDCHQPGGAFYAFPSVKKTGMSSEQFAEELLISEKVAVVPGNVFGPSGEGYIRCSYASSLEQLQEALVRMKRFVEKVGAVK

SEQ ID NO: 7366 - protein, 166 aa, Bacillus licheniformis
MKLTEKETEILEILEENSRLEPETIAKMANISQEETKAIIEKLEKEKVIIDYSAMIDWRKVDGHEGVTAMIDVKVTPKRGVGFDEVAERIYRFQEVESVYLMSGVYDLSVVIRGRTMSDISHFVSEKLSTLESVVSTTTHFILKKYKHDGKVFDSGDDDKRIVVSP

SEQ ID NO: 7367 - protein, 273 aa, Bacillus licheniformis
MLLTKPSIETIQGVNIYYEHYENPGKTSLVLIHGFLSSSFCYRKIIPLLKDEFNLVAVDLPPFGQSEKSSTFVYTYQNMARVVIELIERLKIKDAVLVGHSMGGQISLYAIKERPELFKKVVLLCSSGYLKRSPRSLIFGSHIPYFYLYIKRWLSKQGVLKNLMNVVYDSSLIDQEMINGYLKPFLDDQIFRALARLIRHREGDLSPDDLKKIETPSLLIWGEEDRVVPVQIGKRLHQDLPNSIFYSLQETGHLVPEENPDYVSDKIANFILT

SEQ ID NO: 7368 - protein, 87 aa, Bacillus licheniformis
MIMMKESQAAAQIIHIIKEWDPFQAGPDFYETEAAEIVQAVYTEDDAERLGEAIQTVFEVSFDQTLPLSECKRLAERLLVIKDSSSC

SEQ ID NO: 7369 - protein, 165 aa, Bacillus licheniformis
MEWSSILEWAFQRHLNPMSWYIRPLFLVALAYFCYRRSWKGVIITFLLMTSSMVWFPVPERINPEMQAVLDYELMLLSNPLSAVVTLAFMMGFLVLIGTAFWKRSLGWGLAVLNVTLIGKVVLSVMLTGENGWAPLGNTVFGLILVNGIGLLLIAWREKRGKAGR

SEQ ID NO: 7370 - protein, 387 aa, Bacillus licheniformis
MDFNTEHNRRGTQSVKWDLTQELFGVNDALPMWVADMDFRAPQPVIDALQQRLEHGVFGYTSANAGTKEAVTDWLSRRHGWNTEPAFITFSPGIVTALAQAVQAYTEPGERVVVQPPVYTPFFDIVEKNGRVVLHNPLIEKDGRYEMDFSDLEKKLVEPDVKLFILCNPHNPSGRSWSKEELTTLGELCLKHGVTVVSDEIHSDLMLNGLNHTPFASLSPEFADISITCIAPSKTFNLAGLQASAIIIPDKAKRTAFAKVMQRQGLHSLNTFAIAAIEAAYSKGEPWLDQLIPYIERNMEEVRRFLAEELPEVRMMEPDASYLAWLDCRKLGLSDQDIKRLLLHKGKLILEPGPKYGPGGEGFVRMNVGCSLSVVKDGLRRLKTAFS

SEQ ID NO: 7371 - protein, 66 aa, Bacillus licheniformis
MAPFLIQFMLYFPEDKREYIPSFITLAVFFIIAIAVFRLIIKHSKKEAEKAEKLERELNETIHKRS

SEQ ID NO: 7372 - protein, 129 aa, Bacillus licheniformis
MNNQFQVGDRVKGFYKTGVYIGEITDVKPMHYLVKILAVLTHPKQGDLHHPNRADVPFFHERKALAYGEQTNIPHRMVKPFDEAVPDYADSLRSALSRLKTDLQNDSSEYAAKSLELIHGLEKEYFLHK

SEQ ID NO: 7373 - protein, 205 aa, Bacillus licheniformis
MEASTLLIIDFEFTMPEGKYHPQNFFPEIIEAGIVKTVHDEVVETFSSYIKPKKFPKLTRRCKNFLSITQEQVDQGITFNALIEKLRELDPDRNSVIITWGNMDMKVLKQNCMFNHVPFPFKGEMRDLSMEYKEFFGDKTLTNLWKAAEEYGDSGTGKQHKALDDAMTTYKLFRLVERDKKYLENPKPTTIGERVDLSKVFPHAT

SEQ ID NO: 7374 - protein, 425 aa, Bacillus licheniformis
MQLSHFIYNEREFKFFKKVIRISVYKKNLVIMWFANFFVAASSTMVLPFLSLYIETLGSYSDGFTAKWSGYVFGVTFLMAFLVSPFWGRFGDKHGYKKILLITGTGIGTSILLMSLVSSVYELFFLRMAMGLVTGFIPTSLAMISAQTPKKTAGKVLGTLQMGTVSGGLFGPLLGGLLADRVGFTYTFFITSFAIYSAVFLVFAGVRERPLKQKRDASAGYTRKQVLQTILHQRPLITAMILTAVIQVGNFSVHPLLALYVSELHGTHNLAFFSGLAFSAPGLGSLLAARKWGALGHRFGPGKNIDDSSRLACRGFALSRKELTSQYETLVFFRFLFGIALGGMIPCITALIRVESPGPIQGEVLGYNVSFRFLGNVIGPVLGGILSSFFGISSAFYATAVLFFGGACLLMFQRSQQKKSEAKAS

SEQ ID NO: 7375 - protein, 592 aa, Bacillus licheniformis
MKPLDQVLDEKINIKDIGLVQNSYMYDRDGALISEIVSDHQNRVFVPYKDIPEHVKQLFLTSEDRHFFQHKGFDFIGMARAAAANVKKGGIDQGASTITQQLSRNLYLNHERTFDRKFTELLYSYQLEKKLSKEEIFEKYLNTIYFNHGVYGIGSASSFYFSKPLKSLSLAETAFICAIPNNPTLYDPLKHFDYTKTRQKRLLEGLKKAGVITEKEYSKAVKQKITLNVKEKKDDYPDYTTYVNEEFTKLVSATEGFDERLKKAKTKEEKKKIEKELSNRISSLTTSGIKIYTALDTSMQNRVVQQVKNRLPYEGVQGGAVVINHQTHQIVAMSGGKNYKKYDYNLAFQAYRQPGSSIKPLLDYGPYIEETGATAGSMIDASKFCSKEYCPNNFNERTYGTVSIKTAFKYSYNTPAVRMLNRVGVQKGFSYLKPFGFDKIVQNDYRLPAALGGFTWGFSPLEMADAYTTFGNNGSYTSSHAITKVTDLKGKTLYKWKDKPQQVFSMRTNSQMRELLAAVVKEGTGKKANFSGGYVGGKTGTSNGYRDLWFVGLTDTYTMSVWVGKEAKGTVEYLHHAGPQLLIWRGTLQYAS

SEQ ID NO: 7376 - protein, 135 aa, Bacillus licheniformis
MADMPDRIVLFDGVCNFCDGAVQFIIKHDPEGLFSFASLQSDAGGNLLKQYHLPSDHFNSFILIENGRVYQKSTAALHVVKSLPGLWRAASALLIIPRPLRDAVYSVIAKNRYKWFGQKSECTVPGPEIRKRFLS

SEQ ID NO: 7377 - protein, 185 aa, Bacillus licheniformis
MKNTYVTGFFPFIAILLFSSSLAISSVIYAMQMLSSLGIYKGMLEFFSESGIRMALFAVFTLIFFMVFSALKLIANTVTELALLFFAKDPEGANLRKIRIGSAVYLGASLLSFIFVQYAAGIAALFLLATLVYFIFIVYTIHSTLSFMSLIGFIMFELLFWFTFMIGTVYIIIKLYNSVMASLPV

SEQ ID NO: 7378 - protein, 533 aa, Bacillus licheniformis
MKKTLKLQTRLTIFVCVVVLISLLIAFFMVGSETARNIREQEQQIALQTAEMVAEAPITAQSLESGEYEELRKYTARVQKITQTEFVVVMDMNSIRKTHPDPNKIGKKFAGGDEKEVLKGRRHISTAKGTLGESLRAFVPIYNKTGTQVGAVAVGITLNEIEQITQQNLRPLYTVIVLSIVAGIIGAVIVARKVKTIMFGMEPYEIATLLNERSAMLESTKEGILAVDRTGKIKLANAEAKRLFQKMGIEENPIDRDVLDILPNSRLKQVIETQKPVQDRDVRINGLELVFNEVPIHLKKGNIVGAIATFRDKTEVKHLAEQLSGVKMYANALRAQSHEFMNKLHVILGLVQLKNYDELGNYIKDIAIYQQSEASGIINHIKNSVLAGFLLGKQSYIREQGASLEVHCSTRIPDTANTAVIHDLITVIGNLLNNALDAVSATEKKNISISFRHHDGQLDIEVTDTGVGISKEEQQKMFDQGFSTKGPNRGFGLYFVEQSLENLNGHIVVTSEKNEGTTFSLRIPYEPKEDDHD

SEQ ID NO: 7379 - protein, 235 aa, Bacillus licheniformis
MIDVLIVEDDPMVRELNKRYLSQVEGFQLKGIAASFQEALTFLREEHIDLILLDIYMPGRNGVELLTEIRRQNQAVDVIVISAASEMDVVQKTLRFGAVDYLIKPFEFERFQSALTDYKRKQQLYASNRNISQKELDFELFQKKRAPEKVHLPKGLTKSTLKLIWSSIRSFDSLTFTTEDLANHTEISQVSIRKYLKFLEEIEVLNVEMAYGTIGRPVFQYKLNTNDLNVINQYL

SEQ ID NO: 7380 - protein, 67 aa, Bacillus licheniformis
LAIIAGQGFIALAALVFGKWQPIGALFFSFAQSLSIIGFTLPFFKRNTKRLYADCALRIDDSSAGRI

SEQ ID NO: 7381 - protein, 178 aa, Bacillus licheniformis
MNKSVIPSLITVGNFVSGISSILLAFRGYLFLAIIFVLIGAILDSLDGMAARRLNAVSPFGKELDSLSDIITFGVAPAIITYSIVFYDAPILGLPSTLLFPVCGALRLARFNIQSENQDYFTGLPITAAGTILVCLNLFSEILGKKPFILIMLFLSFLMVSKIKVISLKGKKLLKKVS

SEQ ID NO: 7382 - protein, 160 aa, Bacillus licheniformis
MELAKELISQYGYFAIFGMLVLGIVGLPIPDEVMMTFVGYLSSIHILNYEMCLLISFSGAISGMLISYFLGKKIGKPLLDKFGKWIGLTPKRLDTVHRWFEKYGPWTILFGYFVPGIRHVTCYLSGMNEMDMKRFLIYAGSGAFIWCLVFITIGYTIGVI

SEQ ID NO: 7383 - protein, 263 aa, Bacillus licheniformis
MKKRLYRFLIELTNKKGVSRMLEKFAQSKLSKPLIPSYIKTFHINTEEMLEDVRSFNSLHELFIRKLKSGARPLPADPNSLVSPVDGVIEEMGTITRDKQFTVKQKLYSVEEMIGRSEIVNRYVGGTYIIIYLSPRDYHRIHSPAYGTLETQYSLGSTSYPVNKIGLTYGKSPLTKNYRMISEFKHQYGSALLVKVGAMYINSIVMLQESKEWRRGDEIAYFSFGSTVILLFEKDTFIPDERLHPSLQVKMGEVLGSLAKRTS

SEQ ID NO: 7384 - protein, 286 aa, Bacillus licheniformis; identical to SEQ ID NO: 4681

SEQ ID NO: 7385 - protein, 110 aa, Bacillus licheniformis; identical to SEQ ID NO: 4682

SEQ ID NO: 7386 - protein, 447 aa, Bacillus licheniformis
MEAAKDLKPITNHGHKENKNIFHKLINWKIGVIPFPLYIALALIVFLAAYFNELPNDMLGGFAVIMILGIFLGDVGQRIPILKDIGGPAILSLFVPSFLVFFKVLNPASMEAVTTLMKTSNFLYFYIACLVAGSILGMHRTVLIQGFMRMFVPLLAGTIAAVAAGILVGLLFGYSPYEAFFFIIVPIIAGGIGEGILPLSLAYSQILGQSTDVFVSQLIPAAIIGNVVAIISAGLMKKLGEKRPELNGNGRLVKSKKDDEIFNQKEEEPKIDLKLMGAGVLIACSFFIFGGLVSKFIAIPGAILMIIAAAAVKYAKLLPASMEKGAHQLYKFMSSSFTWPLMVGLGILYIPLDDVASVISLRFIAVCASVVIAMVTSGYFVGKLMNMYPVESAIVTGCHSGLGGTGDVAILSASGRMGLMPFAQISTRLGGASTVIMATVLLRFFTS

SEQ ID NO: 7387 - protein, 74 aa, Bacillus licheniformis
MKRKAFVSLSLFCSLFAGAFMINREMTREQTPGIGTPEGPQYRGDYTPLQTGAEDQSLTGTERAPFKPREYIRV

SEQ ID NO: 7388 - protein, 800 aa, Bacillus licheniformis
MTSLHIAILSPFALAFLIPLLAKNVRKIHTGWFVLFLPVLLFIYFFRMIKMTADGGTLKAVLEWIPSFGINFTAYVDGLGLLFALLITGIGSLVVLYSIYYLSKEREQLGPFYVYLLMFMGAMLGVVLVDNVIVLYLFWELTSISSFLLIGYWYKREKSRYGATKSMLITIFGGLSMLGGFILLYTITGSFSIREMINQVDLISGHGFFIPALVLVLIGAFTKSAQFPFYIWLPDAMEAPTPVSAYLHSATMVKAGIYIVARFTPVFAFSGEWFWIVSLTGIVTLFWGSFNAVKQTDLKSILAFSTVSQLGMIMSMLGVGAAALHFQHFEYYMVAVIAAIFHLINHATFKGSLFMAVGIIDHETGTRDIRKLGGLMTIMPITFTITLIGAFSMAGLPPFNGFLSKEMFFTSMLRITNFNLYNADTWGFLFPVLAWIGSVFTFIYCMVLLFKTFGGKYQPEKLEKQAHEAPIGMLISPIVLVSLVVIFFFFPNILSYSIIEPAAASIMPTLLDGDEKFKVHIYMWHGFSTELYMTIGVVALGVLAYLTLSKWRKVYGLFPETLTLNKLYDSSLSGLEKGSNKITRTYMTGFLRDYLVYVFVFFIVIIGGSLAVTGGFSYDVKGNASIGVYELVLSAVMIAATFTTVFARSRLTAIIGLGVIGYTLALFFVIFRAPDLALTQLIIETISVALFLLCFYHLPKLRFKPKSARFRVTNALVSVGVGTVVTLLALSANSQRSLESIASYFIENSYKLAGGHNIVNVILVDFRGFDTLFEITVLVIAALGIYGMIRLRLEKGGEEH

SEQ ID NO: 7389 - protein, 143 aa, Bacillus licheniformis
MKKVQTNDVILQTVTKIASFIILLFSFHLFFAGHNNPGGGFIGGLMTASSLVLLLLAYDLKTVQNILPVNFIYVAAVGLFISVSTGIGSFLFGAQFLSHAFDYFNLPLLGKTELATAVLFDIGVYLVVVGVTMTIIQTIGERE

SEQ ID NO: 7390 - protein, 113 aa, Bacillus licheniformis
MEILMSFIVGILFMAATYLLLSKSLLRVIIGTAVLSHGVHLLLLTMGGLKKGAPPILNEESTTYVDPLPQALILTAIVIAFGVTSFLLVMAFRAYQELKMDDMDQMRGNDQHE

SEQ ID NO: 7391 - protein, 492 aa, Bacillus licheniformis
MNNLVILPILIPLMAAILLIFMNRSIVLMRAFSAISSIAAIAAAAVLVQTVYTDGIQTLYLGGWKPPFGISLVADQFASLLALTTAIIGFLTVLYSFRSIGEKRERFFYYPAVQFLLAGVSGAFLTGDLFNLFVFFEVLLMASYVLIVIGGTKIQLRESLKYIVFNIISSALFVIGVAYLYAVTGTLNMADLSVRISESGQTGLITVIAVLFLIVFGLKGGIFPLYFWMPGSYYAPPAAVSALFGALLTKVGLYAITRVFTLIFTQDAAFTHQLMVWLAALTIIFGVIGSIAYWDVQKIIIYNIVTAVGVILFGIAANTPASIEGSVYYLIHDMIIKGALFMLGGALFALTGTNNLKKMSGLIKNHPVLGWMFMISAVSLAGVPPFSGFIGKLKIAEGGFLSGEFVITLLMLLSSLLVLYSVMKIFINGFWGDEQEDAPAKRQLKGYMYPAAVLLFLSLAIGLGTELIAPYFHQAADTLVNPEKYIEAVLKE

SEQ ID NO: 7392 - protein, 158 aa, Bacillus licheniformis
MALQILLNFILALCWMFLNNDYTAAGFVIGYVIGLFSLFLMRRFFRRRFYLINIWAIVRLLFIFIKELVLANVSVLKTILSPRLKNKPGIFAFKTDLKADWEITTLANLITLTPGTLVVDISDDRSILYIHAVDIDDAEKAISDIRISFEEAIKEVSR

SEQ ID NO: 7393 - protein, 94 aa, Bacillus licheniformis
MFEFILQLSLGILAVSTFLYVLRVIKGPSIPDRVVALDAIGINLIGITALVSILLNTTAYLEVILLIGILAFIGTVAFSKFLEKGEIIENDRSR

SEQ ID NO: 7394 - protein, 124 aa, Bacillus licheniformis
MIEAAKLLIAVLILLGALISLAASFGTLRLPDLYSRIHAASKGATLGIISVLLGVFFYFWFLHGFITAKVLLGIVFVFLTSPVGAHLIARAAYNTGVKMEKKTVQDDYEGYRNFLIKKKEDSYL

SEQ ID NO: 7395 - protein, 129 aa, Bacillus licheniformis
METKHTLLEALGIELKECSKERCVAVMPVDERTRQPFGYLHGGASVALAETVASIGAYQHIDPKEQACFGLEINANHIKSVKDGTVKAVATPLHVGKSTMVFQIDIRDEQDSLICTSRCTMAVISRPSS

SEQ ID NO: 7396 - protein, 212 aa, Bacillus licheniformis
MRRLLVIDDHPAVMEGTKAILETNQDFVVDCLSPEASEQFLKKHDFSAYDLILMDLNLGEINGMDLSKKILETCSSCKIIVYTGYEVEDYFEEAIRSGMHGAISKTESKEKIIEYIYQVLDNKIVVDYDYFKQLITQQKSKSNSQQTQHDLLTERECLILKEVEKGYTNQEIADALHLSKRSIEYSLTSVFSKLNVGSRTEAVLIAKSEGVL

SEQ ID NO: 7397 - protein, 344 aa, Bacillus licheniformis
MSQTILDVLPVSQAYVLELKSDGTVGLLENNANDQVWKPYEKEAFRAITDIGKIVEVDRGFLIKIGERGGTSYVMLCLSVLNTPRLTRDEISWLETLAFYTSVSLENVLKIGELMEHLENVKKEGPNPAWLNKLMFAIEEKQRSDLARDLHDSVLQDMISLKHQSEMFLADFEKDKVCTNQIRQRLINMNEQMSAVIQTTRETCQELRPQLLYDLGLVKALSKLAAQHQESSSIDKIRLNTERFSKVLDLDTQLNLYRIVQELLSNAVKHSRANEVLIMLVCIKEKVVLHYEDDGIGVDPDKLYQNSASMGLSGIRERVRALNGSLDIQTAEGKGFRVAIEMGL

SEQ ID NO: 7398 - protein, 110 aa, Bacillus licheniformis; identical to SEQ ID NO: 4682

SEQ ID NO: 7399 - protein, 286 aa, Bacillus licheniformis; identical to SEQ ID NO: 4681

SEQ ID NO: 7400 - protein, 380 aa, Bacillus licheniformis
MRVNYNKLSLIIILLSLSLVPYIIYVNLHSSYLGMTMQFNEKNEYQVFEIEKGSLAQSLGFKKGDVILEINGKSVEKLRADDGKLADELSDVKSMIVERDGEIGFVETGYELVSYESLFLFIIPMMFYLLSLFCVYFIIKSNKRLNSASAFILIVFLLVTSTAYSCSVGSAKGDSLSIYITMITFQFVPVLYLHYIYQYFKEKGKEFFNNKIFLFLYPVGLLNLLLEISSDNLQISYSSIKLFNLVSFLVVTIIAFALIIYGVIKNKASEQAYFLRILVITNFVAFIPFLIFYVIPYVFIGDYIFPAMFVVPFLLIIPFSLVYQFIATKIYDIEFLLGRFKYYGLLAILPSLTAVGVFTLTQELSNSLNTVKNTIFIYLN

SEQ ID NO: 7401 - protein, 54 aa, Bacillus licheniformis
MQDIVNFLVENPEVLKKVVDGDACLLGIDPEKTGVVVDSIRLLGKSWGGGGFWI

SEQ ID NO: 7402 - protein, 289 aa, Bacillus licheniformis
MNHFIDLEIPNADLNRTLHAFLDAKDQLHFSELAFYHYQSFGGTDTDAAETLGAGIELLILAFDIFDDLEDEDSPDEPWMKINRSVAMNAATALYTISIKVIGSVSKEPVFFEKLMEYTLQSMQGQHDDLSNRPATEDECLDMIKRKSGALTALPCVLGAMLATGKFDPTVEKYAYQLGIASQIENDYKALFYDSKSDIAKKKRTLAYLYLSRKFNQPSIDLLKTFETEDKIADKEIKCYKEKLKAAGVTQYMYVMNQLAIQKFKKGIGELELGDMEKERLMSTLLNNN

SEQ ID NO: 7403 - protein, 46 aa, Bacillus licheniformis
MEKQQIEELKQLLWRLENEIRETKDSLRKINKSIDQYDKYTYLKTS

SEQ ID NO: 7404 - protein, 112 aa, Bacillus licheniformis
MLPPHCFWMHPYQHVSCRQVYPEVQVSALLRSAKEAESLMADGQRILSRLSASRTLAQQIMTAAQSNQKNNVLAALRQTGVRSQLDASFDPDGIRIMLISPRSRLFLLLRWS

SEQ ID NO: 7405 - protein, 406 aa, Bacillus licheniformis
MRVFVARQPIFNRKEQVVAYELLYRESEKNFFSGIDGDQATTELMINSFLNIGIDKLTEGKRYYVNFTEGLLASGLPTYFDPDQLVVEILEDVPITLELIERCRHLKSLGYTIALDDFCLKHRVKRDLLHQLLASIDILKIDFFKTTQQERQSILRSCRNHRLTFLAEKVETRKEYEQAVKDGFHLFQGYFFSEPVVIDGQDITYHFHAYYELLHELSEDQPDIENVTNIIERDLSLSYQLLKLLNSPANRPIQKIKSIRQAIVLLGFKEIKRWIFILSFKDLTKKQNSSKNEVVKISLIRAKLCELLAKKTNRPQPASYMLTGMFSFIDTLLHKELTEVVSELPLTDEVGQALLGKENDYRKILRLAKSIERNEWEDNTPETEGLTKDEAYQCYLEAVDWCQKLL

SEQ ID NO: 7406 - protein, 489 aa, Bacillus licheniformis
MEHRFTDDSLALHTDLYQINMAETYWRDGIDQKKAVFELFFRKLPFDSGFAVFAGLEKAIEFLRDFRFTESDLVYLKEELGFKDDFLGFLKDMRFTGSLYSMQEGEIVFGNEPIMRIEAPLAEAQLIETALLNIVNYQTLIATKAARIKSVIGEETALEFGTRRAHEMDAAMWGARAAIIGGFDATSNVRAGKRFDIPVSGTHAHALVQAYRDEYTAFKKYAETHKKCVFLVDTYDTVRSGIPNAIKVAKEFGDQIEFSGIRLDSGDLAYLSKKARAMLDEAGFTDTKVVASSDLDEYTIMNLKAQGAKIDVWGVGTKLITAYDQPALGAVYKLVSIEEDGKMADTIKISSNPEKVTTPGLKKVYRIINQLNHHSEGDYIALDYEKVNEQERLKMFHPVHTFISKFVTNFDAKDLHQPIFEKGELVYENPSIQDIKRYVQENLSLLWEEYKRISKPEEYPVDLSEACWNNKMQQIHEAKIKAKKGLDQG

SEQ ID NO: 7407 - protein, 183 aa, Bacillus licheniformis
MKKALICIDYTNDFVAADGKLTCGEPGRKIEDAVARLADTFIQNGDYVVFAVDSHEAGDTLHPETRLFPPHNIKGTSGQDLYGKLEKLYRKHEHDQNVYYMEKTRYSAFAGTNLELKLRERDIQELHLVGVCTDICVLHTAVDAYNKGFNLVIHQNAVASFNPDGHDWALSHFANTLGASVSD

SEQ ID NO: 7408 - protein, 133 aa, Bacillus licheniformis
MSDQSLDQYLQQGMYGPRETKPDERRLFLGSLRERVIIALTKGQVLRPKAYREVIDALGSKADATLLLNGEIGYSHLSPYIKESNKQGVPFSIVSDQQSDTPLGLVLAAREAVEKESIYVQDDIFEQSVLNKR

SEQ ID NO: 7409 - protein, 81 aa, Bacillus licheniformis
MTKMKIRKANILNEDQMITDVYLHENKKEFHTLVAVPQLEWSTLISYEEEKAELAEKLDRSLSKVAESDAAESCPKRSYNG

SEQ ID NO: 7410 - protein, 73 aa, Bacillus licheniformis
MPAIVGPIFIRRVVDDSAAFFGDVFAISPKCTDSSGGGAGTFQTGDYGLIHNDINKTTFTDADVMDGSQSLNL

SEQ ID NO: 7411 - protein, 378 aa, Bacillus licheniformis
MKKAGRKQSLLKSKTHFWTLQILLVLLIIYVSTKVSFLFEPIIVFASTLFTPILIAGILYFIFNPIVRLLEKKLPRTLSILLIYLVFVAFIGFVLSAVGPVFTKQVTDLFNNIPSYVKQIQIFIKQMSNSQWFTWIMNQDFVSVAKIESSIGEYLTSLPENITGSLTSVFGVVTNIALTAVTVPFILFYMLKDGHRFPNLAVKILPDKYKNEGLKIFKDLYETLAAYIQGQLIVCLFVGTACFIGFWIAGVKYALILGLIIAVTNIIPYVGPFLGAAPAVIIAFLDSPTKALIALIIVVAVQQTDGNLLSPLIIGRRLNTHPLTIILLLIGAGSFGGILGMILAVPAYALLKAFTLNIVRLVRLRQRYKKETAENPEV

SEQ ID NO: 7412 - protein, 144 aa, Bacillus licheniformis
MKISSRFTIAVHMLSLMHVRSDHLTSEQIADSVNTNPVIIRQISRLLKKAGLIEVKRGTGGAHLLRDAGAISLYDVYKAVEVVGEGELFHTHENPNPDCWVGANIHQVLELVLLKAQTAMENILKEMSIKELTDLIIQKKNASQ

SEQ ID NO: 7413 - protein, 298 aa, Bacillus licheniformis
MTNHIKEINWEQNTNSYIQLIPNIEYTKVEDTSLTLHLLVYRNPMDALFNRKGNQETYPLIIYLQGCGWGWTKQDTSAFIPQLVPFVEQGYVVASVQYRGSGEAVFPAQLHDVKTAVRFLKANAARYNIDPDRVGVWGDSSGGHLALLLGLTEGIEEFEGPDEYRHVSSKVDAVADWFGPVDLLSMSKYPSIFDHDSPNSPESKLIGGAVQENRVQAKQASPISYVHREAPPILIMHGDQDDVVPYQQSVQLFEALIKEGHDALMYKINGAGHNGFTQAHTLDIVKSFFRKHLKPGKA

SEQ ID NO: 7414 - protein, 487 aa, Bacillus licheniformis
MKKLVLLMLVLLLVYPHVSKAGGFKGGGGNPGYWFAGDPVEHPDPAKPPIVFVHGLNGSSSAWFDENDMAEQAWKNGYDAAFIDLHPDKDMQDNGAMLAAKLREIYQYFGRKVILVSYSKGGIDSQSALIHHNAYHYVERVITLGTPHHGSQLADLAYSNWAGWLADILGQKNDAVYSLQTGFMKSFRDQTDNHPNRLKTKYFTLAGNKIGGFGSALFFGGVYLNMFGENDGAVTEKNARLPYATNLDTGKWDHFSIIKGNLTFPVFMPLLTIQANANETAATKENLSYPFIRGGENHGLREEEFAVEKGVKEITVHWLSNHSSGNIKLTDPRGKPFKDFSIAKTADVFEGGFVHSAAIKNPAAGTWKIASSVKQKEAFLFIVTFDSPLNQQIKNAVTRESSNLANVKASVRSIRYENGKQAEKKSLKPASINALQNSLSFKKAGMYSVTIDLSGKTADNSPFNRTIIRSIYVNDKGEKFENSPLSD

SEQ ID NO: 7415 - protein, 176 aa, Bacillus licheniformis
MRNVTLMDVFTHPIAQKYLTRSGVAHAVACAYHSYRLAVRAGVDPDIATKAALLHDIGHYEWYTDGEWDYEKYKQNDIHAIKGAERAHKLLIRLGEDRKAAKEIALAILLHTDSYLPEGDLDKNKLQQIVKKADELDEEPGGNHHYRKIDHKLALEKIRKLDRMVDESLSPMKRTV

SEQ ID NO: 7416 - protein, 243 aa, Bacillus licheniformis
MHLSIVTGASKGLGAAMAEGLLQKGHIVHAVSRTKSDISHDRLIQHEADLAQLAETEKWFRQFSDSVQAHDFASITLINNAGMVTPIKRAGEAEPEELRLHYDLNLLAPVMLSQLFTKWLKPYKGKKSIVNISSGAAKNPYKGWSAYCSSKAGLDMFTKTFGFEQEDESDPVKMISFSPGIMDTGMQEVIRSSSKKDFHEIERFKTYQTEGKLRSTSYVAGILLDLLETDFENGRVYDIKEFL

SEQ ID NO: 7417 - protein, 150 aa, Bacillus licheniformis
MAVMLSFFLFTPIAKAEETDKVDVKPNEYEKQDIKIETDYLQEEEAEYKEEISIPEELKEFSFTDSKKEDAIEKLKSLSGSFTNESNSVASKLKQLDLSFSANPSLSGREDDSAENRQSIFLPILYGLLILLCIAGLFFLIPKVSGQQKK

SEQ ID NO: 7418 - protein, 1009 aa, Bacillus licheniformis
MTEQQKSTLKIISAIVTIILLPVLFFHFIGENPTKKVSNATREIAVVNEDTGVLKDDGTVDQDALLGNEISASLVDRPDYKWTVVNRSAAESGLAEKQYDAIVYIPSDFSQNILSYNHERPQKAELEFKIQDQLDAVNKEKVQRELQDAQKTVSKKMSSLYWRFVKQGVKKVRKEFDSIVNKESEFQNAMYNFYKPSSNNLAGEVERQKEMIDRLKESINETEGTSKERNASVEESKKQLDSFVDNVNQYKQYQEKQSELLMAAQADSEGQIQDGLTVIKEKQSSATSRFNEQMSGMAASFNGLQNQFSLTANSFQNLQTMRENQVPLQAIGIESIQKQLIDDYQDQTKLERLRGLQPDLISMRSELAKGSEDDSNDNPGNEDKEDQDKGDEEEPKDLKIDLQEQQDELKSIAADLKELSDGLKDSSGNEGDNSGDKEPSAGDPNQGQEPSPGTGENGQQGDAATPSDEINDQGTGEDDQQLKPGNEQPEDENAKLKEQLNEAAARLEKLEEDLRAKQDTHNEELEKQIENLNKKISSLKENIKDLKHEIKDLKVDIENLNKNFDVIYDSIKKIENGILEYLPKDSDRRETLSKAFESTIRTRDVDQLLKYYKLLSNYETTLYGSVDYTIKNNVISAKKDSVNTVLKIGETEAEKWSNLKNNMLSTNEDIENYTKDMTDFVKSYGDFINEKQTDVLNELSTISDRANAVSEQLRNPEGAGTAVMQGDATDGTMVISMQDTLGNDILQLSNMLGSLSETQSGVIEYTSNIQESVNDVQKKADTLNSNWGQNVATTKLIRGDVYGILGNAFGGNDGYVYDHLASPVKISGDVPESKAQNVPPVVILVIVMLSSLLIGYFSHHYQNAPLLVRGALFGILNIIVGLMISLFGLNIYSLADDQAVMWSVFTILLLVASSAIIRTAFMLGSIAGGIATAAMVLFYVAPLLDLAMPNFSFNNPVSTVYMSIQYGTGSQFALGIGALILITIIAIAVPFIVDFAKSRTEESETDHDA

SEQ ID NO: 7419 - protein, 1494 aa, Bacillus licheniformis
MSLLWIFYHKNYQKIKLDDQNSRTLTIGPDLKHSVTIKHFSFEKGPVTLEKQKDSDALNVQLGGETVSSLKLGGKASVQSGAEQLTLFLAEEADSVPAYYLGERQEIVISSLDQEADVYFNETDSFFGEKGTFSFIRLDGQWNVLPNDAKIYLNGEEVSAPVSVQNGDEIAFGLNILRIVEDDLLEIEGFGKFDTSLENILKPSSETKNKYPQYRRPPRMIYDLPDEKVSFSFPAQESDGDNRGLWLMILPPLVMLIVMGIVALIQPRGIFIIVSLAMFMMTLITSTVQYFRDKNQRKKREEKRERVYTLYLENKKKELHELAERQKFVLDFHFPTFERMKYLTKEISGRIWEKSIESADFLQIRLGTGNVASSYQINLNGGDLANRDTDHLLEQTQKMEEVYRELKNAPITVNLAEGPMGVVGKLSVVKNEIHQLVGQLAFFHSYHDLRFVFIFDEAEYQEWEWMKWLPHFQMPHIYAKGFIYNEQTRDQLLSSIYEILRERDLDENKKKTLFKPHFVFIITNQQLIAEHVILEYLEGKQKHLGVSTIVAAETKESLSENIHTLVRYITEQEGDILIKQKKAVQIPFQLDHHNREDNEQFSRTLRTLDHQTGMTNSIPDTVSFLELFQVKEVDDIGIEQKWMTSESAKSLAVPIGYKGKDDIVYLNLHEKAHGPHGLLAGTTGSGKSEFLQTYILSLAVHFHPHEVAFLLIDYKGGGMAQPFRNIPHLLGTITNIEGSKNFSNRALASIKSELKKRQRLFDQYKVNHINDYTKLYKQKKAKTAMPHLFLISDEFAELKSEEPEFIRELVSAARIGRSLGVHLILATQKPGGIIDDQIWSNSRFKVALKVQDANDSKEILKNGDAATITVTGRGYLQVGNNEVYELFQSAWSGAPYMEDGYGTEDEVAIVTDTGLIPLSDVDADRAAKKEAVTEISAVVEQIERIQAEMGIEKLPSPWLPPLEERIPKTRYPSEEADAFNFAYIDEPEKQSQEPISYRMMEDGNIGIVGSSGYGKSLTATTFMMSFAEQYTPEELHYYIFDFGNGTLLPLARLPHTADYFLMDQTRKIEKFMVRIKAEIEHRKNLFRAKEISHIKMYNALNEEKLPFIFITVDNFDIIKDEMHELESEFIQFSRDGQSLGIYLILTATRVNAIRQSLLNNLKTRVVHYLMDQSEAYSIIGRPEFSLEPIPGRVIINKENQYFAQMFMPVEADNDIELFEGIKADIQAIAERSEGMRKPAPVPMLPLELSVTQFVRDYPLQPERGLIPMGLDEETVEPVYFNLEKNKHCLIMGQTQRGKTNVIKIMLEHLLDHDTKKIAVFDSIDRGLSQYATEDQISYLETKDDILLWLAETEEICRTREAMYLEAVKQGEIANLDFSPMVFIVDGISRFQQTIDASIQDKMAMFMKSYAHLGFHFIPAGNHSEFTKGYDSLTSEVKQVRHAMLLMKKSEQNLIQLPYERQEPEILPGFGYIVENGKERKIQIPLCAVERKKAK

SEQ ID NO: 7420 - protein, 438 aa, Bacillus licheniformis
MAEKKKTYLEDQLEAVMTKEDGTYIFRFQREKINLVNGLEANVIKEVDPSFNKEAVMTDDEVQIMIQPPSEYKEFRYIKGKNKKSKWLFAYQLVKAVEEHSIKRLHLIAAPENIVFDKGLTPKFLHYGVKESIPPYEHDEERLFNEVKAAAALAVDGQFSFEEYLKYSETIKFSDQVKDIITSGTYGDLKAVIQKRIDELDAKEKMLVHLPKKKWKIQRYIGLGLILCLIPAVLFSFYSLFFAQPKQQAFIESNRYFLNKQYSKVISTLDKYDADEMPDSVQYQLAYSYIIVDNVLKEADLQEDAMKSLTLQVDPNNFLYWIQIGRGANKEALETARKLENNAQIMLALMKYTDDIKADDKLSSDERQKQLDPLEKELEELKRTADEQKAKTEENQQANTEQNQADVEAAKAETEKAEKEQAKKENKEKEDKKKKDDK

SEQ ID NO: 7421 - protein, 79 aa, Bacillus licheniformis
MYVDITIDLKHYDGSVFDLRLSDYHSVKKVVDIAWQAKSIPVPPREGYWVRVTNKDAVFSGEYTLSQCGITTGDRLEIL

SEQ ID NO: 7422 - protein, 98 aa, Bacillus licheniformis
MSGIIRVTPAELRQMADRYQKESGDVTEQVNQRLDQMINQLQDMWEGESSRAFSEQYQELRPSFIKMAELLSDVSKQLHQTANTLESTDQDIASQIRG

SEQ ID NO: 7423 - protein, 469 aa, Bacillus licheniformis
MAILEKINGFLWGVPGIVMLAGTGLFLTFILRGLQFKRLIYAFKLAFGKEKESAGADGDVSNFKALMTTLAGTIGNGNIAGVATAITVGGPGALFWMWLVGLLGMATKYSERLLATKYRVKNERGEYSGGPMYYVEKGLGKKWKPLAVLFALSGVLASFGIGDSVQSNTISEVVTQSFGIPGWIIGLVLAVLTAAIIFGGFQRVSTVASIFVPVMAILYIGGSLIIIFLHYDQIIPAFQLIFYHAFNPVSAAGGFTGVVVSEAIRNGMSKGIFSNEAGLGTAALIAGNAKSDHPVKAALVAMTGTFIVTLIVCTMTGLVLIITGFWDPSGGLLSGVAHDASLDAGALTNAAFASSLGAAGKYIVTFSVIFFGYSTIVGWYVYGEKCLEYLVGLKWVPLYRVVYVIAAYYGAVASLNTVWAFADAANALMMIPNLIALVLLWKVIRAETDDFFLHHYNKEKQKSAGLKAG

SEQ ID NO: 7424 - protein, 412 aa, Bacillus licheniformis
MNNRNNPFKYQYDRLEDVADHISEVLDCPITIEDINHRLLAYSTHSDYTDPARTSTIIGRRVPEKVINKLWKDGTIPALMKTDEPIRVEQIDEVGLSSRVAISIWKNSEVIGFIWALESQKTLSEDELHLLKLAADSVKNKLLPYQVRKRKNEQRSQEFFWKLLTGHISEDQEISDGFHQLGIGVPSTYSVIIIRLKDEIEEKTEKQLHYLLETTQQLQILLATIDYNELIVLASPKTGQKGQPFNDLKQFAANIQKQLEERYKLNNCTIAIGGMYSLITLVHQSYQEALSALKVKERFPDETRHLVSFSELGIYQYLDVLSEKRKHASYPNYSLMQLEAYDKEHHSNLVETLEQFIECDSNVNTAAKKLNIHVNTLNYRLKRISKIAEIDLKNINEKFTIYLEIKLRNMHL

SEQ ID NO: 7425 - protein, 379 aa, Bacillus licheniformis
MIIGVPKEIKNNENRVALTPGAASQLIAAGHRVIVEKDAGTGSGFENEDYVSVGAEISEQAEAVWEAAEMVMKVKEPLPEEYPYFREGLILFTYLHLAAEPSLAEALKQKGVTAIAYETVSNGRSLPLLTPMSEVAGRMAAQIGAQFLEKPKGGKGILLAGVPGVARGKVTIIGGGVVGTNAAKIAAGLGADVTMIDLSADRLRQLDDQFGNQIKTLMSNPVNIADAVAEADLLICAVLIPGAKAPTLVTEEMVKQMKPGSVIVDVAIDQGGIVETVDHITTHDNPTYVKHGVVHYAVANMPGAVPRTSTVALTNVTVPYALEIANKGAEKAILENPALKAGVNTANGHITYEAVARDLNYGYVPAELAIENSSSAAGA

SEQ ID NO: 7426 - protein, 81 aa, Bacillus licheniformis
MFFVQLFIFLMLSACFWLFIASFKKKAFAVLLLLTAAAVLALFAAVGDASDRTLWRIVLFGAVPVSAIAAKLIQDRRKTES

SEQ ID NO: 7427 - protein, 197 aa, Bacillus licheniformis
MFFGKTKPHKSDRVPPNQNVTTSFPVLHAGHVPEYEDLSKWNLQIYGLVEQPLLLTLDDLHEMPQSEVSNDIHCVTGWSKLDNVWEGIKTKEIAERVKPLPEARFVILHAEEGWTTNVPLEDFLKDSSLLAHSHNGAPLTPEHGFPLRAVMPHLYFWKSAKWLRGIQFTKENHPGFWEKNGYHLRGNPWKEERYSFD

SEQ ID NO: 7428 - protein, 198 aa, Bacillus licheniformis
MNNKKLRAGDMALVGMFAALMGIGANITSFAPFLQIGGIPLTMQPFFCLLAGLLLGRKLGALSMIVYALVGFIGAPVFASFSGGISVLFKGSAGFILSYIPAAYAAGWITDKLSEPKTGHFFAASLIGTLIIYLIGVNYTYLAFSTWLNTPMSYSAVWKMMAWFFVKDLAFSVLLAALASKVFRAVQKGAGFRRNPTF

SEQ ID NO: 7429 - protein, 442 aa, Bacillus licheniformis
MNAVVIAVIVMLILSLLRVNVVLALIVGALAGGLTGGLGLGQTVSVFTEGLGGNATVAVSYALLGAFAVALTKTGLPDAMVEAAVKLIGKEGDTRRKTLSKALIVFVILIISCMSQNVVPVHIAFIPVLIPPLLKILNELQVDRRLIACAMTFGLTAPYILLPVGFGQIFQGILKDNMKDAGLSVTLADIPIAMIIPIVGMIAGLAVAAFVYRKPRTYEMKEIAGQKSASYTKKSLSIAVLAIAVSLSVQLYLSQSLDVDGMIFGALSGLAVLFLSGAMKRGEADELITNGMNMMAFIGFVMLAAAGFANVLEKTGDVKALVEASTGFISNNQVLGALLMLVVGLLITMGIGSSFATIPIIATIFVPLCMQLGFSPMATIAIIGTAAALGDAGSPASDSTLGPTSGLNADGQHHHIWDTCVPTFIFYNIPLILFGWIAAIVL

SEQ ID NO: 7430 - protein, 496 aa, Bacillus licheniformis
MFYAFKDFEKKETLLIGLFKKSRLYGKAEEIDRLLNGQLSQLLKDGDVSSKKAKVSKIFTPSLQGVKRIYIVGLGREAEFTFEDAKQCFAEAVQLIHKDRKQELTVMLDSFVSEEVPAADAAHALAESCMLSCYEVQDYKHRSNVPDQCLQSVYVLTDHDLKEIQASLHVGQVYGNATNSARTLVNMPGNMLTAADLASYAAELAAKYEFECEILEKAEMEELGMGGLLAVNQGSEEPPKMIVLKYQGKETWDDVIGLVGKGITFDTGGYSIKTKSGIVGMKSDMGGAASVLGAMEAIGELRPEQNVLAVIPSTDNMISGSAMKPDDVIVSLSGKTIEILNTDAEGRLALADGLTYAKHHGASVLIDVATLTGGVVVALGTETTGAMTNHDPLYQQVRQAAEEAGEAIWQLPITEKDKKRVKNSQMADLNNSPGREGHAIMAGTFLGEFAEQTPWVHLDIAGTATTAQNSCFGPKGGTGVMVRTLVTFVERFSGNL

SEQ ID NO: 7431 - protein, 158 aa, Bacillus licheniformis
MEILTNFPLLASFAAIFFAQFIKVPIYFVVSKKWDWRLVTSTGGMPSSHSAAVTALSTGVALDHGMDSSLFAVSAIFAVITMFDATGVRRHAGEQATVINRLVRDFNRFVNEAKDFPKSHQEEKQKKLKELLGHQPIEVFFGGLTGIALTLLLDYLLM

SEQ ID NO: 7432 - protein, 224 aa, Bacillus licheniformis
MRKVMTMFRRFLMTVLFVLAFMTTFFAVSGVEAQDISSWAKERDLSLKQLMLTFKSLPEEKAEKTSLSAAEQIKNKPKSLEDAFDWSKYPKQKVTATGYTAGAESTGKQPHHPDYGITYSGVKVKRDLYSTVAADPSVFPIGTILFIPDYGYGVVADTGSAIKGNRLDLYYETVEDVYKEWGKKTLDVYVIKKGNGTITEEDLLKLNENKSMQVFRQKYKMAKE

SEQ ID NO: 7433 - protein, 109 aa, Bacillus licheniformis
MEALISLPVVIISVVLFFVLFFGIGFLLNMLLRMSWIMAVIYPIVCLFIVNKEKLIRYVEAPGEAFSGLFDRVASLAAADIIILASGMAGALLSGVTIKALRKRGYQMF

SEQ ID NO: 7434 - protein, 42 aa, Bacillus licheniformis
MKTTSTHRLESTCTFCSGKGYFQLLLGGSETCSNCKGTGKDR

SEQ ID NO: 7435 - protein, 387 aa, Bacillus licheniformis
MTVTRLVKKIGINEANITLVNKHNYHYETTWMHEASAGTLHHDRCRYQIKDVINTSRVNFVQDTVKKIDKEGKKVVLETGELSYDYLVVALGSVPETFGISGLKEHAFSISNINSSRQLREHIEYQFATYNTEAEKRPERLTIVVGGAGFTGIEFLGEMANRIPELCREYDIDRQQVRLICVEAAPSVLPGFEPELVDYAVNYLEGKGVEFKIGTAVKECTPDGIIVGKDDQTEEIKAGTVVWAAGVRGNPIIEESGFENMRGRVKVKPDLRVEGHDDIFVIGDCSLIINEETERPYPPTAQISMQQGETCANNLAALIHGKETETFSFDNKGSVASLGEHDAIGVAFGRKMTGTTASMMKKIIDNRSLFMIGGPGLVLKKGKFKFF

SEQ ID NO: 7436 - protein, 332 aa, Bacillus licheniformis
MREDTKVYDITIIGGGPVGLFTAFYGGMRQASVKIIESLPQLGGQLSALYPEKYIYDVAGFPKIRAQELVDNLKEQMAKFDQTVCLEQAVESVEKQADGIFKLVTNKEIHYSKTVIITAGNGAFQPRKLELESAAQFENANLHYFIDDLNQFAGKRVAVLGGGDSAVDWALMLEPIAKEVSIIHRRDKFRAHEHSVENLRNSKVNVLTPFVPTELIGSERIEQIVIEEVKGERKEIIDVDDVIVNFGFVSSLGPIKNWGLEIEKNSIVVKSTMETNIEGFYAAGDICTYEGKVKLIASGFGEAPTAVNNAKAYMDPKARVQPLHSTSMFENK

SEQ ID NO: 7437 - protein, 66 aa, Bacillus licheniformis
MEKINCRSCGGLTPYDSKVCEACGCEKPLPKSQKITDRIVLTAAGVVGILTIVLILGTIFSYLNII

SEQ ID NO: 7438 - protein, 74 aa, Bacillus licheniformis
MSYYNNRNQEPLPKEDISTWECTAEDCNGWMRKNFTSSDRPLCPLCNKEMISGSRYITSITNNTSNLNRIFNQK

SEQ ID NO: 7439 - protein, 184 aa, Bacillus licheniformis
MKKTPFISMLHRDEKAFYYGLGEKEMKLVSTHALSKADVTAFFHTHWGSPEMVNSHGTFRCDELEGFAVTDEKSDIKGLITYFIAGNECEVVSLDSVVENKGIGSLLLQEVERVSKRKQCKSIKLITTNDNMRALMFYQKRGYTLAELYVNAVDKARKVKPEIPFVADNGIPIRDEILLVKDLA

SEQ ID NO: 7440 - protein, 121 aa, Bacillus licheniformis
MSEKTVTVTEAAALHIKDMMKEHEEENAFLRIGVKGGGCSGLSYGMGFEHEKNEDDNEFVQHGITVLVDQESLDIMNGTVIDFKQSMMGGGFTIDNPNAIASCGCGSSFRTAANAGKPEEC

SEQ ID NO: 7441 - protein, 285 aa, Bacillus licheniformis
MNSFRFTKMHGLGNSYIYVNQFEEHLPEELLSDLAVKVSSVYTGIGSDGMILICPSDRAPVKMRIFNSDGSEGKNCGNGLRCVAKYAYEHKLVEETSFLIETLSGLVKAQVEVDEGKVVSATVDMGEPRLLKSDMPMRGEQGSETINEKMIFGGREMKGTAVSMGNPHIVFYLDDIEKAPLTTMGPLIEKDERFPEGVNVEFVEVENENELHFRVWERGSGITQACGTGACAAAVSSVLNGYSKRDTDITVHLAGGDLIINWKNDGRVMMTGPAETVCEGEFFIS

SEQ ID NO: 7442 - protein, 405 aa, Bacillus licheniformis
MNILWGLLGILAIFAIAFLLSEHKSKINIRTILIGLAIQLLFGFIVLKWETGREAFLWFTKAVQHLVNYANEGISFLFGPLLQVGDSAAFALSVLPVIIFFSSLIAVLYHLRIMQVIIRFIGGGLAKLLGTSKTESLSAAANIFVGQTEAPLVIKPFIANLTKSELFAVMTGGLASVAGSVLFGYALLGVPLEYLLAASFMAAPAGLIMAKMLIPETEKPKIEEKDIQMAEDEDAANVIDAAAKGASTGLSLALNVGAMLLAFVALIAVLNGILGGVGGWFGFKDLSLEYILGYVFAPLAFVIGVPWDEAVQAGSFIGQKLVLNEFVAYSNFAPMFDQLSVKTASIISFALCGFANLSSVAILLGGLGGMAPNRRSDIARLGLKAVAAGTLANLLSAAIAGMFIG

SEQ ID NO: 7443 - protein, 78 aa, Bacillus licheniformis
MFPIVEFCVSNLAQGSQEAKEILEKDPNLDVVEYGCLSYCGQCMQTMYALVNGEMVTANNPAELVENIYKFIDENELI

SEQ ID NO: 7444 - protein, 355 aa, Bacillus licheniformis
MRNLVLLGGGYGNMRIIHRLLPNQLPDDVMITLIDRNPYHCLKTEYYALAAGTISDHHIRVSFPDHPKLKIEYGTISSVDLEGKKVLFHDREPVSYDDAVIGLGCEDKYHNVPGAPEHTYSIQTIDQSRSTYQALNNLNAEATVAIVGAGLSGVELASELRESRKDLNIILFDRGELILSSFPKRLSKYVQSWFEEHGVKIINCANITKVEEGIVYNHDDPIQADAIVWTAGIQPNQIVRDLDVEKDPQGRVVLTPHHNLPGDEHVYVVGDCASLPHAPSAQLAEAQAEQIVQVLELRWKGEPLPETMPKFKLKGVLGSLGKKAGFGLVAERPLIGRVPRLLKSGLLWMYKHHNG

SEQ ID NO: 7445 - protein, 123 aa, Bacillus licheniformis
MEVFEEYLAGIDHPEHRARMEEVLGWVAETFPNLTPKIAWNQPMFTDHGTFIIGFSVAKNHLAVAPESAGIDRFSEEIVQAGYDHTKQLVRFRWDRPVDFSLLEKMIEFNIADKADCSTFWRK

SEQ ID NO: 7446 - protein, 368 aa, Bacillus licheniformis
MKTKIAYEEVAGMLNQWYVMIKRHEVSQAVSIKCDIEHQLPNMEENQDLLLYFNLLDYRHKLLTEEFAASNKLFEDIQEQKADMQSTDDMIEYYYFFFAGMYEFHKKDYTNAINYYKLAEEKLRTIPDQIEIAEFHYKLAIAYYQIKQNFLSLNHAKTALKTFKAHDDYIQKAISNDMLIGANKLDLFRFDEAEQHYKQALKDAALIKHHVLLGMAHHNLGLSYVNRNLLTLAEHHFKEALLIKEHEESVYGIHSMFELTHVLYKSNVVKEARKLYEKGFFRAEKAGEREYLSKFKLIHALYDEQDPLTVEHALEYLKTINLWTDVAELTFDIALYYKENGDADKAAEYFEESHHARDQILKRTEELK

SEQ ID NO: 7447 - protein, 166 aa, Bacillus licheniformis
MNQDVKEFVGSHMIYTYENGWEYEIYIKNDHTIDYRIHSGMVGGRWVRDQKADIVKLTEGVYKVSWTEPTGTDVSLNFMPNEKRMHGIIFFPKWVHERPDITVCYQNDHIDLMEESREKYETYPKYVVPEFADITFIENAGIDNEDLISKAPYPGMTDDIRAGKRV

SEQ ID NO: 7448 - protein, 88 aa, Bacillus licheniformis
MSSIEGQIMSGDFDDEMNVFSLKKIKQFQTQTSLKENQLKALQHYLRQHEHDEDGQIITLYDQMLVPLSQDDIKALLDDLTKVQSLYH

SEQ ID NO: 7449 - protein, 108 aa, Bacillus licheniformis
MKKQAELFVYGADVLCPSCVNLPSSKETYEWLEAALKRKYPDQPFSITYIDIHQPPENDPEKQEISEKILNDEYFYPLVMVGDQVVGEGNPKLKDVYKEMEKQGYKPA

SEQ ID NO: 7450 - protein, 79 aa, Bacillus licheniformis
MTTEVEMKEQVQEVLDKLRPFLLRDGGDCELVDVEDGIVKLRLLGACGSCPSSTITLKAGIERALLEEVPGVIEVEQVF

SEQ ID NO: 7451 - protein, 653 aa, Bacillus licheniformis
MKQLITEKDLIKLVSITDPQYSPDGAKIAYVQTKVNEKQDSYDSHIMIYDREKQASVQWTFGKGRNQHPRWSPDGKYLAFTSNREETAQIYVISAAGGEARKVTDIPYDVSQPEWSPDGKSLLCSVKLTKEESVDDEKKTEIEDHEPLEVDSLSYKADGQGFKRGKYTQLVLVQVETGEMKQLTDLERDHFSHAFSPCGDQIAFCANQTDMRVNDVYLMNLSTGDLKRLTGQNGIFSSLSFSPDGKHLAFIGNEKEYQNATLDKAWLYDIETGKLTCLTEMLDVHLSDAVAGDSLVGGVLPKPAWTKDGNGFYVIGSDQGSTGIYYISIEGLAYPVRLEKEHVNGFSLHPDESGFAASIALPVRPSELYHLQLGEEKAERLTDANQAFTEEHIISEPEELQFQAADGLTIHGWLIKPAQYEKGNTYPLILEVHGGPHAMYANAYFHEFQVLAAKGSAVVYVNPRGSHGYGQDFVNRVRGDYGGGDFKDVMAAVDHVLEHYDFVDQERLGITGGSYGGFMTNWAVGHTKRFKAAVTQRSISNWISFYGVSDIGYFFTDWQLGADLFEDPGKLWEHSPLKYADKVETPLLILHGERDDRCPIEQAEQLFTALKKMGKEVKLVRFPNASHDLSRSGHPKQRIRRLEYIAGWFEAYL

SEQ ID NO: 7452 - protein, 306 aa, Bacillus licheniformis
MTEADMLFSVTVPGSTANLGPGFDSVGMALSRYLRLSVFPHDEWRFEAETEVVAGIPEGTDNLIYQVAKRTAAHFGKELPPSLVKVWSDIPLARGLGSSAAAIAAAVELANELADLKLSDREKLHFASLEEGHPDNAGASLFGGLVIGLHEEDETEMVSMKDIDLDVVVVIPFYEVLTKDARDVLPESLSYPKAVEASAVSNMLVAGLMAKDWKLVGRMMQKDLFHQPYRRALVPELSKVEHEAGQNGAFGTALSGAGPTILSFIEKGKGEALRNQLASKFPHCEVDCLYVPDTGIIVERKSVNSV

SEQ ID NO: 7453 - protein, 352 aa, Bacillus licheniformis
MWKGLIHQYKEYLPVTDKTPELTLNEGNTPLIYLQNLSKKLGIELYVKTEGVNPTGSFKDRGMVMAVAKAKEEGNDTIMCASTGNTSAAAAAYAARANMKCIVIIPDGKIAFGKLAQAVMYGAEIIAIDGNFDDALKMVRSICEKEPIALVNSVNPYRIEGQKTASFEICEQLGEAPDILAIPVGNAGNITAYWKGFKEYHEKNGTGLPVMKGFQAEGAAPIVKNKVIEKPETVATAIRIGNPASWDKAVNAAKESNGKIDAVSDEEILHAYQLLAREEGVFAEPGSCASIAGVLKQLQTKEIQPGAKVVAVLTGNGLKDPNTAVDVSQIKPVTLPTDEEAILEHLKGAARV

SEQ ID NO: 7454 - protein, 433 aa, Bacillus licheniformis
MKAIRVGLLGLGTVGSGVVKIIQDHQDKLTHQVGCPVTIQKVLVKDKDKKRDVELSKDVLTTEAYDVIQDPEVDVIIEVIGGIEETRRYLLDALQAKKHVVTANKDLIALYGSELTAAAKENGCDLYFEASVAGGIPILRSLEDGLASDRITKMMGIVNGTTNFILTKMNKENAPYDEVLKEAQELGFAEADPTADVEGLDAARKMAILARLGFSMNVDLDDVKVKGISQVSDEDINFSKRLGYTMKLIGIAQRDGQKVEVSVQPTLLPEHHPLSSVHNEFNAVYVYGEAVGETMFYGPGAGSMPTATAVVSDLVSVMKNMRLGVNGSSFVDPQFEKKIKAPSEIFAQQFLRIHVKDQVGSFSKITSIFSERGVSFEKILQLPIKGHDDLAEIVIVTHHTSEEDFTDILQKLNDLEVVHQVKSTYRVEGNGWS

SEQ ID NO: 7455 - protein, 320 aa, Bacillus licheniformis
MDKPFVYVTRKLPEEQLSALKEEAHIEMWEKEEEPCPRAILKEKAKKAHGLLTMLSDTIDEELLKGAPHLKVVANLAVGYDNIDVEAAQKHRVICCNTPGVLTESTADLTFALLMASARRIVEASDWIRQGKWTGWGPLLLAGADVHHKTIGIVGMGSIGQAVARRAKGFGMKILYHNRTRNPDAEAELGASYLPFDELLEQADFVVCLTPLTHETKHLFNRSAFKKMKRSAIFINVSRGQVVNEDDLYEALVEKDIAGAGLDVFAEEPVQKDHPLVSLPQVTALPHIGSAAVETREAMMRLCAENIALVLRGKQAKTEI

SEQ ID NO: 7456 - protein, 340 aa, Bacillus licheniformis
MQEVMSVKELIKEKFGIYIRDLTSYLSYQAFHTPNSMFLIVPVSHLSQDELAELFSMSQYLQEQRDPYVSSFILTKDGEMTFEENGVSYVLLQAAPRMTNRSVSFGAELAEFHHKGRGYPYEVKETSRIGQWKELWGKRLDQLEQFWIQKTQARQLQPFEKQFIESFPYYLGLTENAIQYLADTELDDQPQAADSGTICQQRLTCEALRREPLIKIPMEWVFDHAARDLAEYARSLFHERKNFNEIMLFLQQYEQAAPLSSFSKRLMYSRLLFPLHYFETLEGYYISPESEHHYFESRLDYLLSQAPAYEQFLNGFQEMAGMRSAGLISMPPVNWLKRTP

SEQ ID NO: 7457 - protein, 169 aa, Bacillus licheniformis
MKMMPENNSMHQIETAAKEWLEKRGVKISEIADLVYVLQKKYHPNLTKEECEENVNRVMKKREVQNAVITGIQLDMLGEQRKLMEPLQTLIETDESLYGVDEILSFSIVNLYGSIGYTNYGYIDKIKPGVLARLNDKSTGECHTFLDDIVGAIAAAASSRLAHRAKDAE

SEQ ID NO: 7458 - protein, 256 aa, Bacillus licheniformis
MKTYKGYLIDLDGTMYKGTEKIEEACEFVRKLKDRNIPYLFVTNNSSRTPKQVADKLVSFDIPAEESQVFTTSMATANFIAEQKPDASVYVIGEEGIRQAIEEKGLAFGGEDADFVVVGIDRGITYEKLAVGCLAIRNGATFISTNGDIAIPTERGLLPGNGSLTSVLTVSTQTEPIFIGKPEPIIMEQAMKVLGTDISETLMVGDNYDTDIMAGMNSGMDTLLVHTGVTKKEHLEAYQEKPTYVIDSLTEWLDRV

SEQ ID NO: 7459 - protein, 147 aa, Bacillus licheniformis
MMYFVDRHKIENTLNFLEEELRLYQMQEEWTSDVEKKALERIGHTLIECILDIGNDMIDGFIMRDPGSYDDIMDILTDEKVVSQAEGDSLKHLIAYRKTLVQDYLNVNHEELEELLSRHAETLEKFPARIRDYLNHELGPVSAFKPH

SEQ ID NO: 7460 - protein, 91 aa, Bacillus licheniformis
MIVVQNAAFEVVKDVKNGFNEEAFKARYSDILNKYDYIVGDWGYSQLRLKGFFDDQNQKATFDTKISTLDEYIYEYCNFGCAYFVLKRLRK

SEQ ID NO: 7461 - protein, 207 aa, Bacillus licheniformis
MNKKILLAGLVALPLAGCQTALNDTEHNIYDEDGNTVHVADKNPQYQEKFRNDNRKGRFGYARHQATPVANKEEMQAPQIDREEMAHIISSLTVQLPNIQDASALVTDEEALVVYKTDSGQRKQTADQVKKTAASVVPRYYHIYISDDPDMMQSVANFSRLGANSRNVDQLMADTIKEMQKSPQGKTTTGTDENGNDLDGKGKATES

SEQ ID NO: 7462 - protein, 298 aa, Bacillus licheniformis
MAKKDEHLRKPEWLKIKLNTNENYTGLKKLMRENNLHTVCEEAKCPNIHECWAVRRTATFMILGSVCTRACRFCAVKTGLPTELDLNEPERVADSVSIMNLKHAVITAVARDDLKDGGAGVFAETVRAVRRKSPFTTIEVLPSDMGGDYNNLKTLMDTRPDILNHNIETVRRLTPRVRARATYERSLEFLRRAKEMQPDIPTKSSIMIGLGETKEEIIETMDDLLANNVDIMAIGQYLQPSKKHIKVQKYYHPDEFAELKEIAMEKGFSHCEAGPLVRSSYHADEQVNEASKKRQAQA

SEQ ID NO: 7463 - protein, 326 aa, Bacillus licheniformis
MKAVLSVLILLLLILQPCALAKEKKEPDLQKRMALYHKTEAATHIPWYVFAAVDQYEINIRKNRKDLPKQKGHTGIYIPQSVWSGPENPNPKDTSPLSIKVFDGIGMDGNGDGLAEPDQDEDVLYTFGQYLLTYGRDIENIRIGLWEFYERDQTVGIISGFIRLFQKYGHIDLGKHAFPLPVRSDYSYRSTWGDARGFGGRRIHEGTDLFAHYGLPVRSTCYGIVEMKGWNRFGGWRIGIRDINNTYHYFAHLNGFTKGLKVGEIVEPGQVIGSVGATGYGPPGTSGKFPPHLHYGMYKDNGRTEWSFDPYPHLKAWERKELRKKK

SEQ ID NO: 7464 - protein, 37 aa, Bacillus licheniformis
MNGASIAMMVIGIVIIWGGLAASIINAVVKSKKSQAG

SEQ ID NO: 7465 - protein, 509 aa, Bacillus licheniformis
MDNRPQWGTRAGFILAAVGSAIGLGNIWRFPAVAYENGGGAFFLPYLFALLTAGIPLLIMEFTIGHKYRGSAPLSYARMGKGKEWIGWWQVAISFVISTYYAVIVAWAISYTVFSFNLGWGKNTENFLMNKYLNRIDIGGGAIGQFGGFVPGVLIPLAIVWIVSLGILFAGVKKGIEIANRIFIPLLVVLFFIIVIYSITLDGAAQGLNAFFTPDWSQITNGKVWVAAYGQIFFSLSIAFAIMITYSSYLPKKSDITNNAFITGFGNSSFELLAGIGVFSALGFMAAQQGVPVKEVVSSGIGLAFVVFPQIINEFPAFNAFFGFLFFGSLVLAGLTSLISISETYVAAIQDKFNVPRRKAVLFGGGAAALCSLVFATKGGLFFLDAADYFINNFGVALAGLIEVVAIAWFAKELKALQAHANSVSDIQLGAWWRICLSVVTPIVLGYMMFDNIKTNITTAYGDLPVEFLLKWGWCVAFGAIAAGFILSLSKWKNGLAYTPFQHDKEVSS

SEQ ID NO: 7466 - protein, 257 aa, Bacillus licheniformis
MRRLRGPLSKRGPLPLRYVMLLSFIFFIFSTAVSLLIINSSIKPTLLNIAEMETNRIATHVIQEAVEDYMSQDENVKNLVEMKTNENGKVTTIDFNSHGLSGMHSKITKQLHEKLKETETEEFNSSAKTPEGKNDGVIYNIPLGQATGNSLLGNLGPKIPVRFNVVGDVFTDFKQSVEPYGINNALINVGVLVEVKVRVVIPFATKTAVVKNTIPATIQAVHGEVPDFYSGNGSQTAPSIQIPSKDEKTEQKKEQKE

SEQ ID NO: 7467 - protein, 101 aa, Bacillus licheniformis
MVNLTPIMIEDQPFTAVTVKLPKTNFMAVTNDHGYIMCGALDVALLNDKLKERKIVAARAVGVRTIDQLLEAPLESVTDAAGELGIHPGMSGKEALLKMVK

SEQ ID NO: 7468 - protein, 451 aa, Bacillus licheniformis
MTEKLHIYHTNDLHSHFENWPKIVDYIQTQRQKHEEQGEEVLLFDLGDHVDRFHPISEATFGKANVELLNRLQYDAATIGNNEGITLPHQELDTLYDNAQFPVVVSNLFDGEGKRPGWAAPYLLKKVKSGATLAILGVTVPYYPIYRQLGWTVTDAFESIGEMLSEIKEKADTVILLSHLGILDDQRVAEAFPEIDLILGSHTHHLLEEGMMKDGVMLACAEKYGNYVGHVELTYNGALENITATVMKTADWNEESEETIRFLKEKEREAGHLLEEEIATLDNTLETAWFRRSALPQMLADALKEWCEAEIGMVNSGIVLESLSQGPVTKADVHRICPHPINPVKLKLTGRELKEVILHASSEQTEKLRIKGLGFRGEVMGKMLYAGLDPEKLSVNGADIEDDAFYTLATIDMFTLGTLFPVIRDAEDIDYFMPEFLRDLLAWKLKKANRS

SEQ ID NO: 7469 - protein, 273 aa, Bacillus licheniformis
MEYLILIILGFIAGTIGSLVGLGGGIVIVPSLLFLAGLPTLFDHVTPQMAVGTSLVVIIFTGLSSTIAYMKYKTVDYKSGLIFFIGSGPGSIVGAHVSTYFSSDSFSLWFGIFMILISLSLMIKKRVKPAEKKHTGVIRTFTGDEGQEYTYSYHPLAGIAIAFFVGFLGGLFGIGGGSLMVPAMILLFLFPTRVAVATSMFIIFLSSVAGSAGHVISGHVNWLYALALIPGAWFGGQLGAYINKKMQTKTIVLIMRFVLILIGIRLIYQGVFS

SEQ ID NO: 7470 - protein, 283 aa, Bacillus licheniformis
MIYIGLTGWGDHDSLYPPKTSSQNKLIHYSSHFPIVELDASFYAIQPERNNEKWVKETPETFQFIVKAYQGMTGHQRGEIPFETKDDMFAAFKLSLTPYIKAGKLAMVLFQFPPWFDCKKENVNYLRWVKEKMGDIPCALEFRHRSWFMPQFYDKTLAFMEEQQWIHSICDEPQAGEGSIPTVLHATDSRKTLVRFHGRNKEGWLRPSSGQNWREVRYLYLYNEQELKDWKRNLELLEQQSKNVYVLFNNNSGGDAAQNGKQMMELLNIEYKGLTPRQLDLFS

SEQ ID NO: 7471 - protein, 173 aa, Bacillus licheniformis
MILACEIGFWIFILLGLIFRYMAGWKKAGLIMFACTPVLDLLLLAATSLDLHNGAQADVLHGIAAVYIGVSIAFGSRMIKWADERFAYRFAGGPKPDKGPQYGREHAKKEREGWFRHFIAWLIGAALLAGMHLFIGDPERTEPLIRIASLWSIILVIDFLYSFSFTLFPRKAR

SEQ ID NO: 7472 - protein, 194 aa, Bacillus licheniformis
MPKIVDHEKQKEKIAEAVWNVIHRDGLEQCTVRNVAKEAGLSAGSMRHYFPHQSELFIYSMRLVANRVKTRIENMTFNGTPAENVKQLLFQLMPLDEERKLEMEAWYAFTAKSLSDPELKPLRKEMNEGIYSACKSAVEILVKTEKKTGIDVLKETEHLYALVDGLALHLIMAPERLTAERIDTVLAGYLRSLE

SEQ ID NO: 7473 - protein, 73 aa, Bacillus licheniformis
MKKKRFGILFLVLFLLLFNTASQAADPNQKTTEEVLLNAFDKFGLVSSVIGKTDQLYQSAQMILAAKKNSENT

SEQ ID NO: 7474 - protein, 408 aa, Bacillus licheniformis
MTIGEMNIPKRTIMTPGPVEVHPRVLRALSSPVLGQFDPAFTDMMNDVMALLRQIFRTTNKWAFPIDGTSRAGLEAVLASLIKPGDRVLIPIFGRFGYLLAEICERYQADVYTMECPWGDVFEPKEVISEIKRTKPEIVAVVHGETSTGCIQPLEEIGRACRELDVLCVVDAVATIGGTDVNTDEWCLDAVVGGTQKCLSVPSGMAPITFNSRVEKRINERKKVERGIATREDIVLETGRLPISSNYFDLGMLMDYWSPRRLNHHTEATSMLYGLREGARVVLEEGLRERFSRHRLHETALIKGIKAMGLELFTEGRKKLPTVTCVKVPDRVDADLVRKMMLDDFGVEIASSFGPLAGKIWRIGTMGYSCRKENVLFTLAALEAVLIRTGASVSPGNALQAALDFYHE

SEQ ID NO: 7475 - protein, 417 aa, Bacillus licheniformis
MTIGIHKTGESTARNIEDMINWLASFGESGEGGVTRLLYSKPWLSAQQSLKEKMEDWGIEPYFDDAGNLFGRIEGTENRTKAILTGSHIDTVINGGKFDGAYGILASLLSAKHLLDTYGRPKTSIEVVSLCEEEGSRFPLTFWGSGNLTGLFDCQKTPAVHDRDGVSIEQAMKDCGFGKRRYRRPFRRDVKCFIELHIEQGSILEESGRQIGIVTDIVGQRRFTVMVKGESNHAGTTPMNARKDAVAVSALCISYLTNKAKAAYPLLTATVGRIEAKPNVPNVISGEAVFSLDLRHHHDAVLDRYCDDIFAYFTELAGEWNVQITVEQTTDAKPVRMDRDLIQLSKQSAEDLDVSYQEMVSGAGHDAQVFGPHCPTSLLFVPSRKGISHSPEEWTKPADLAAGVELLTHVLYRLAYE

SEQ ID NO: 7476 - protein, 532 aa, Bacillus licheniformis
MNIYDMMKLPVFKGATLAAGKAGVTRNIEHINMMDAPDIADYLHHGELLVTTAYHLKDRPFLLKELIERMIRRGCAGLGIKTRFLQEIPDEVIKLADERTFPIIELNEDVRLGDIVNHTLSHILDKRTAELEQAIAAQKKFTSHIMSGKSIQSLLHNVSAVLKLPVLLFNQHLKPIASSKADAAGTLSDYEGIFQKGNRTGLTCFSTIPDKQTYSVFPIYTHEKKCGFLVVCGMISPSDKGLLLTLEQAANVIAFELLKENALKQYLRRARNEFFRNFLDGAFSSAEEIKNRAKEFQLKWDQKYVCIAGKLDRREKSLSFTENQLESDSVFERLEEELVDFPFPPHLFTKGNICFLLAEATDSWAEMNAAVGGFLKAFQRHASEHFQRTISFGISNLSHQLRDVPHICKEAVDALHSGHLSGSTEFIQTYHMKDVSELLRMIPADDLKTFYTHALHQLASLPKDDPGLLQTLSVYLETHCQISETAKRLYIHRNTVIYRLEKCEELLGKSLKDADTTLRLRLALRIQMLLGL

SEQ ID NO: 7477 - protein, 398 aa, Bacillus licheniformis
MKKMARLYMLMLNVFIVMLGIGLIIPLMPTFIEEFGASGSTLGLLIAASGITQLLFSPVAGEMTDKYGRRKMIILGIGAFAVSQLLFALASQMWLLFVSRLLGGAGAAFLVPAMFAYIADITSEKDRSKGMGLISAAMSLGFVIGPGAGGYLAAFGLTFPFYVSAGLAGLATVLSLLVLPETLSQEKMLEKRRSVQKREPLAKQMARALRSPYAFLFILVFILNFGIMNFEAVFSLYVDHKHGFTPGDIAFVITAASLIGVFVQAVALGMLTNRFGEKKLMNMTLIGSAGALAVCSIAGSYWLVFGATIVFFMLTSILRPAINTLISKMAGDEQGFAAGMNNAFMSLANIVGPTVAGLLFDVNVEIPYIFGVVVLVLSFLAAVSWGRKQQARTIPEKV

SEQ ID NO: 7478 - protein, 468 aa, Bacillus licheniformis
MGMPAYKTEEVKKNEKRKKEFPHIYVILAVMIGLMALATYIIPAGEYERVESPDGREMIDPASYKRVEQTPVDILGLLTAVPKGMTEAAPIIVFTFVIGGAFAVLRKASVIELGVRLLADQFRNKPVFVTPVLIFVFSGISCFIGTPELSIVYVPVILPLLLSLGYDRMTAAAIALCGTIAGFTSALTNPFTVGTSQMISGLPLYSGMGYRAVIFVVVTAIAAVYVLKYAEKIRAHPEKSLTGKEAVEPVPAFKAGGRVKWAGIAALGLFAGLIGCVIYFRWDMLTMAGYFLALGIIPAYIAGMNSRDIAESFNEGFKEVLVGAMICGIARAAAVVMADGQIMDTIVYGLSHAVSQLPSYLTVTAMLFTQMLFNFFVPSGSGQALIMMPIMAPLADIVGITRQTAILAFQFGDGFSNIVFPTSGYFMATLAISRIAWNKWLRFILPLFCLWMGAAVLFLMFANAVGWS

SEQ ID NO: 7479 - protein, 244 aa, Bacillus licheniformis
MQQWIKEVARGKRGARDLTYEEARQAAEAIVTGNASPAQTAALLIAERIKTESPEELFAFTEALRNSSESLSLSRAVKEAVIDFAGPYTGRHSFLATIPVSLLLAGNGVPAFLHGSDALPPKYGTSVKDVLDKLGIPSETAPAQTARSLEKALIGFAAAETFCKPFVRMRKIREEIGVRTVLNTAEKLVNFSDADKLMMGAFHRTAIQKMHPVFQRLTYKEVFIVQGRRARKMCRSTEAALCLQ

SEQ ID NO: 7480 - protein, 115 aa, Bacillus licheniformis
MPVHRGSFVFTIKNGEIDSFILKPEEYGLYAEEAKLNKPLSAEEQAEKITAVLAGDESADTEYERKQVIMNAALRYYLFGYCAAIEEGVQAAEKQLKEKAGLEALERWKASFTRP

SEQ ID NO: 7481 - protein, 270 aa, Bacillus licheniformis
MNRKCVIPFILMLSAMCAPAQNAEAFQLFSLPVQSSAPADYYEQAQGKTGEALKRALHDTIDDHRELSYSEVWEALKATDEDPANRNNVILLYSRESRSKQANGGQTGDWNREHVWAKSHGDFGTSKGPGTDLHHLRPSDVQVNAARGNLDFDEGGSPYPGAPGNYYDGDSWEPDKSIKGDVARMIFYMAVRYEGDDGHPDLEMNNTTNNGSKPYHGKMSVLLKWHHEDPVDALERKRNDIIYQQYQHNRNPFIDHPEWAEDIWGSGVLN

SEQ ID NO: 7482 - protein, 279 aa, Bacillus licheniformis
MIQFDFEYYSPQSAQEAVKLFQSLEREGKKPAYCSGGTEQLMLGRMNVIHTNAVIDIKDIPECRTLQFERHHLALGSALTLTEITENGGFPLLSKAAREVADHTARNKITLGGNICGQIFYREAVLPFLLTDSKVVTVGDKGKKRYLIHDVFDQQLKLSKGEILISLLIEERYLHQPFASIKVRQRWDTGYPLATISALEIDGRVRCAFSGVCSYPFRSAEVESALNDEALPVGQRVEEAINRLPGPVLDDAQGSAEYRTFVIKHTLFDILGMLKKETL

SEQ ID NO: 7483 - protein, 347 aa, Bacillus licheniformis
MTLIDRGERGRATDAAAGIVCPWLSQRRNQAWYKLAKGGAAYYADLIKQLEADGESDTGYKRTGAISLHTDERKLEKMEERAHLRRKDAPEIGEITRLSHEETKRLFPPLAEGYSSVHISGAARVNGKLLRRSLVNAAKKYGASVVSGNASLLYEGNRVTGISTGGKKIYADQVLVTAGAWADELLKPLGVRFSVSYQKAQIVHLCLPDADTGSWPVVMPPNDQYILAFEDGRIVAGATHENEAELDDLRVTAGGLHEIFSKALAVAPGLELSELLEARVGFRPFTPGFLPVIGSLPNICGLLVANGLGASGLTSGPYLGAELARLALGEEPELDIALYDPAGALES

SEQ ID NO: 7484 - protein, 286 aa, Bacillus licheniformis
MTVVGFCVLLCSAFIHASWNYLSKKADGGVPFIWLFTAIAAVIYTPLAIGVVIYEKPEIGIWQLVIIMASILAHLGFFLVLQKGYKKGDLSLVYPIARGTGPLLTCMLAVAFFGETLTLPAIIGILLIVISILFFTGGVKRLKESGSFTPVLYGLAVGGIIAAYTLLDKAAVSRFLIPPLLLDYCNTLGRLVILTPYAAKSWSEVRFEWKHHRMEAVGVGVFNSLAYILALSVMVFAPVSYVAPVREISILIGTVMGAVLLSEGFGRLRIIAAALMVLGVISVAAG

SEQ ID NO: 7485 - protein, 127 aa, Bacillus licheniformis
MKMLKKAVLIAAVFLLAAFAGSTEAFAMPSKGAVKFRTDANTYTKSATSIVVTGKSPVTGTMIAVRLINKKGTVLIYRDVHLTRGKPHFRVSFPTKKLKPGKYDVWVDAVKGKKWHGELKRYIVIKH

SEQ ID NO: 7486 - protein, 373 aa, Bacillus licheniformis
MSVIPYDLVATKMNFWYTALKNNWTGKAEDTKKEVERELEQMEQNQDVIVYYNLLLFRHNLQLDYMYSKPGVNLNSRFDEFKKIRDQNNLEGMLDYYYHFFAGMYHFRQKELILALNFYRDAEKKLDSFDCDELEKAEFYFKASEVYYHMKQTIFSMNYASRAYNLFKKYDTYGERRVQSQFIIAGNWLDHMYPEKALHNLNKELKESETQGILHLMGSSHLNIGICYNKLEDVDKATYNFQRALNLYKEEKHSFLPKTLFNLAHVRAKQGKLSITDDLYYEGKELAEKNKNLDMLAKFDLIKGLYLSFDLDMVRESFKFFESKGKYADMEEYGLIAAELLEKKEKIRDAVEFYRITVNARRQIQRSAFLHVN

SEQ ID NO: 7487 - protein, 465 aa, Bacillus licheniformis
MAKKMPDIGEYKYGFADKDVSIFRSERGLTKEIVEEISRMKEEPQWMLDFRLKSLEHFYNMPMPQWGGDLNSLNFDEITYYVKPSERSERSWDEVPEEIKQTFDKLGIPEAEQKYLAGVSAQYESEVVYHNMKEDLESQGIVFKDTDSALKENEDIFREHWAKVIPPTDNKFAALNSAVWSGGSFIYVPKGVKVDTPLQAYFRINSENMGQFERTLIIVDEGAHVHYVEGCTAPVYTTNSLHSAVVEIIVKKGGYCRYTTIQNWANNVFNLVTKRAVCEENATMEWIDGNIGSKLTMKYPAVILKGEGARGMTLSIALAGKGQHQDAGAKMIHLAPNTSSTIVSKSISKQGGKVTYRGIVHFGRKAEGARSNIECDTLIMDNKSTSDTIPYNEILNDNISLEHEAKVSKVSEEQLFYLMSRGISEEEATEMIVMGFIEPFTKELPMEYAVEMNRLIKFEMEGSIG

SEQ ID NO: 7488 - protein, 148 aa, Bacillus licheniformis
MSFNVNLDTLYRQVIMDHYKNPRNKGVLNDSIVVDMNNPTCGDRIRLTMKITDGKVEDAKFEGEGCSISMASASMMTQAIKGKDVETALQMSRIFSDMMQGKDYDDSIDLGDIEALQGVSKFPARIKCATLSWKALEKGVSKENSDNE

SEQ ID NO: 7489 - protein, 406 aa, Bacillus licheniformis
MNAKDIREQFPILSQQVNGHDLVYLDSAATSQKPRVVIETLDEYYNSYNSNVHRGVHTLGTKATDGYEGAREKVRKFINAKSMQEIIFTRGTTTALNTVALSYARANLKPGDEIVITPMEHHANIIPWQQAVKATGATLKYIPLQEDGTISLDDVRETVTENTKIVSAAHVSNVLGTINPIKEMAKIAHEHGAVMVVDGAQSTPHMKIDVQDLDCDFYTFSAHKMCGPTGIGVLYGKKALLENMEPAEFGGEMIDFVGLYESTWKELPWKFEAGTPIIAGAIGLGAAIDFLEDIGLDEILAHEHRLAAYALERFKELEGAVVYGPAERAGLVTFNLEDVHPHDVATVLDAEGVAVRAGHHCAQPLMKWLNVSATARASFYLYNTEEDIDKLIEALQKTKEYFTNVF

SEQ ID NO: 7490 - protein, 437 aa, Bacillus licheniformis
MTLETKLSVDREYVKSFSEKHQEPAWLQDLRLEALEKAEDLPLPKPDKTKITNWNFTRFDKHTVENKPLDSLDDLSDEVKSLIDLGNEDKTLYVQRDQTPAYLSLSKELQDKGVIFTDIHTAFREHGELVKKYFMKDGVKADEHKLTALHAALLNGGAFLYVPKNVELEAPVQAVYVHESNDTTLFNHVLVVADDNSAVTYVENYISTVNPKEAVFNIVSEVITGANARVQYGAVDNLSAGVTAYVSRRGTALGRDSKIEWALGLMNDGDTISENTTNLHGDGTFGDTKTVVVGRGEQTQNFTTQIIHHGKHSEGYILKHGVMKDSASSIFNGIGKIEHGASKSNAEQESRVLMLSEKARGDANPILLIDEDDVTAGHAASVGRVDPVQLYYLMSRGIPKEEAERLVIYGFLAPVVNELPIEGVKKQLVSVIERKVK

SEQ ID NO: 7491 - protein, 261 aa, Bacillus licheniformis
MAASTLTIKDLHVEIEGKEILKGVNLEIKGGEFHAVMGPNGTGKSTLSAAIMGHPKYEVTKGSITLDGKDVLEMEVDERAQAGLFLAMQYPSEISGVTNADFLRSAINARREEGDEISLMKFIRKMDENMEFLEMDPDMAQRYLNEGFSGGEKKRNEILQLMMIEPKIAILDEIDSGLDIDALKVVSKGINKMRGENFGCLIITHYQRLLNYITPDHVHVMMQGRVVKSGGPELAQRLEAEGYDWIKHELGIEDETVGQEA

SEQ ID NO: 7492 - protein, 311 aa, Bacillus licheniformis
MAHSHGHTGHSHHGSRSANQKALFISFGLIFTFMMIEVIGGILTNSLALLSDAGHMLSDAAALGFSLLAFKIGEKAASASKTFGYRRFEILAAFINGITLLLISLYIFWEAYNRFFSPPEVAGRGMLAIATVGLFVNIAAAWVIMKGDTSGNLNMRSAFLHIIGDMLGSFGAIIAGLLMLFFNWNIADPIASAVVAALVLVSGWRVTKDSVHILMEGKPKDIDAEALKNGLLSIPSVREVHDLHIWSISSDMPSLSCHIVADENSDRDRILKQVSKYLRKECNVEHVTVQIEGERCSPHESCSLGANHPRS

SEQ ID NO: 7493 - protein, 38 aa, Bacillus licheniformis
MGYEEYSRSHVNRLEVEKRREKQYQKSKQIVSDLPIIG

SEQ ID NO: 7494 - protein, 122 aa, Bacillus licheniformis
MNQHESEGIIESALHEYKAGIGIFSEKMPGIAAKYNEFTEECFKKGVLSEKDKQLIALGISVNTQDEYCIIYHIKGCLDCGASEEEILEAVGVTAAFGGGAAMSQAVTLVLQAMEEFQQMKH

SEQ ID NO: 7495 - protein, 276 aa, Bacillus licheniformis
MKKGLLTALFIIFAGVLAACGSSSSEGDKDSKVITVGATPTPHAEILEEAKPLLKEKGYELKIKNFTDYKLINKALATKDLDANYFQHVPYLEQEMKENKDYDLVNVGAVHLEPFGIYSKKYKSLKDLPDGAKIIMSNNAAEQGRMLAMLENAGLIKLKSGIEKVDATVKDITENKKNLKIKNDVAPEMTAKAYEANEADAVFINVNYAIQNKLNPKTDSIELESPKDNPYANIIAVRKGDEDSDKVKALMEVLRSDDIKKFIDKKYKGSVISVSE

SEQ ID NO: 7496 - protein, 222 aa, Bacillus licheniformis
MFEKLFPNVDMEQLWEATYETIYMTGISLLFAFIIGVILGMLLYLTSKGNIWQNRVVNGVISAIVNVFRSIPFIILIILLLGFTKFLMNTILGPNAALPALIIASAPFYARLVEIALREVDKGVIEAAKSMGAKTSTIIFKVLLPESMPALISGITVTAIALIGSTAMAGAIGSGGLGNLAYVNGFQMNNPDIILIATIFILAIVFIIQFIGDFITNKLDKR

SEQ ID NO: 7497 - protein, 341 aa, Bacillus licheniformis
MINLQNVSKIYRSKHGDVNAVQDVTLTIKKGEIFGIIGYSGAGKSSLIRLLNGLEQPTSGTVEVAGRKISEIKGKKLRKARQEISMIFQHFNLLWSRTVRDNIAFPLEIAGVSKAKRLERVAELIKLVGLEGKENAYPSQLSGGQKQRVGIARALANNPKVLLCDEATSALDPQTTDSILGLLSDINERLGLTIVLITHEMHVIRKICHRVAVMENGKVVEEGDVLNVFIKPKEEMTKRFVQQVTEPVETKETLKHFLEETTSGRTIKLTFVGEAAESPLITQIIRKFDVEVNILQGKISQTQDGAYGSLFIHVDGRENEVNDVVDFIKSRQVEAEVITNV

SEQ ID NO: 7498 - protein, 115 aa, Bacillus licheniformis
MEKMGLIEREGKALFLKPLLSTTALLITFQGEKEAFTLAINEKGEMEKYSPVEKAHLTFFGEQSEIIDLLHGDISLQHLVQRGTVKVKGSFRALLKLEAILWLTDGFFKNSDLYS

SEQ ID NO: 7499 - protein, 102 aa, Bacillus licheniformis
MQELQEKELKRLEHETCLLYVYTPFCGTCQLAGRMLEVVDEMMKDIPFYKNNLNYSPSFAKQQEIESVPCFILYKKGRVVKKEYAFHSVSYLYDTIKQNLVD

SEQ ID NO: 7500 - protein, 114 aa, Bacillus licheniformis
MPENEKVMIVEGKSDKQKVKHVIEEPVDIICTNGTISQAKLDEFAETLFDKDVYILVDADESGEKLRRQLKRELPQASHLYIDRVYKEVASAPSQHVAEVLFRSNIRVHTKYLL

SEQ ID NO: 7501 - protein, 81 aa, Bacillus licheniformis
MSKLTLKKERIDITEHVESRLKNGGTQLYHENELIGRMTGKDQYELKSGYSFQDEKFYKMADTVSGPDAKYVDCDDHQGWC

SEQ ID NO: 7502 - protein, 127 aa, Bacillus licheniformis
MSTPKELRYSEEHEWVKTEGDKVRIGITDFAQSELGDIVFVELPEVGDEIKADEPFGSVESVKTVSELYAPINGKVVEVNEDLEDSPEFVNESPYEKAWMIVVEPSDASEIENLMTAGQYEDMIKED

SEQ ID NO: 7503 - protein, 118 aa, Bacillus licheniformis
MALDFYWYPKCGTCRKAKKWLEDHGKEINGIHIAEQPPSKEKLKELYEKSGLELKKFFNTSGQKYRELGLKDKLQSMSEDEQLELLASDGMLIKRPITTDGSKVTVGFKEDQFKTYWL

SEQ ID NO: 7504 - protein, 594 aa, Bacillus licheniformis
MEQTKDHMKKGGAFLIEEVTADQMFTPEDFTDEHKMIAKTTEDYILGDVLPYIDEIEEHNFDHSVRLLKKAGELGLLGADVPEEYGGLGLDKISSALITEKFSRAGSFSLSYGAHVGIGTLPIVFFGTEEQKKKYLPSLATGEKFAAYALTEPGSGSDALGAKTTAVLNEAGTHYILNGEKQWITNSAFADIFIVYAKIDGEHFSAFIVEKDYSGVSTGPEEKKMGIKGSSTRTLILDQVQVPKENLLGEPGKGHVIAFNILNIGRYKLAVGTIGASKRVIELSASYANQRQQFKTPISKFSLIGEKIANMSVKLYAMESSVYRTVGLFEDKMGTLSEEEQKDGRQVAKSIAEYAIECSLNKVFGSETLDYIVDEGVQIHGGYGFMQEYEVERAYRDSRINRIFEGTNEINRLIVPGTYMKKAMKGELPLFEKAKALQEELMMLMPEEPGDGVLEQEKYLLRNAKKTALMIAGLAAQKYGKALDQEQEILVNIADIVSQIYAMEAAILRTEKAIRATGEDKNAQKILYTQIFAQEAFQEIESHAKESLIAMESGDSLRMMLSALRKLTRFTPVNVIEKKRQAAKGVFEAEKYIV

SEQ ID NO: 7505 - protein, 391 aa, Bacillus licheniformis
MKEAVIVSGARTPIGKAKKGSLRTVRPDDLGAYAVRETLKRAGGYEGNIDDLIIGCATPEAEQGLNMARNIGALAGLPHTVPAVTINRYCSSGLQSIAYGAEKIMLGAADTIIAGGAESMSIVPMMGHIVRPNAALAETAPEYYMGMGHTAEQVAVKYGVSREDQDAFAVNSHQKAAKAIAEGKFEDEIVPVDVTVREVDEHHNLKERTFTFSADEGVRPGTTKDVLSTLKPAFSANGSVTAGNSSQTSDGAAAVMIMDREKADALGLKPLAKFRSFAVGGVPPEVMGIGPVEAVPRALKMAGLELSDIGLFELNEAFASQAIQVIRSLGIDEEKVNVNGGAIALGHPLGCTGTKLTLTLIHEMRRRSEQFGIVTMCIGGGMGAAGVFELV

SEQ ID NO: 7506 - protein, 796 aa, Bacillus licheniformis
MVKHIRKAAVIGSGVMGSGIAAHLANIGIPVLLLDMVPHELTDEERKKGRTLEDPDVRNRLARTAVQKLLKQKPAPLTSKKNISRISTGNMEDDFEKIKDADWIIEVVVENLEIKKQVFSKVDQYRKQGSIVSSNTSGISVRQMAEGRSADFKKHFLGTHFFNPARYLKLLEVIPIDETEPEVLSFMKKFGEDVLGKGVVEAKDTPNFIANRIGTYGLLVTVQEMLKGGYTIGEVDSITGPLIGRPKSATFRTLDVVGLDTFSHVAKNVYNQVTGEEKNVFRLPEFIEQMLEKGWIGSKAKQGFYKKEGKDILELDPMTMTYSARQTLKTSGLEAAKQMKGAGARLKALVYSDDRAGSLLWKITAPTLVYSAELTGEIADSITAVDQAMKWGFGWSEGPFEMWDSIGVKSSVQKLEAEGWKVADWVKEMLAKGHETFYLKENGKTFYYCFESGEYRALQENKKTIHLSSLKETKGVIKKNSGASLIDLGDDVALLEFHSKSNAIGLDIIQMLKFALEEVDANYKGLVIGNQGKNFCVGANLAMMLMEAQDDNYMEIDMIIRQFQETMMKVKYSSKPVVAAPFGMTLGGGTELCLPAARVQASSESYMGLVETGVGLIPGGGGNKELYLNYLKGLPEGVKPDIQEAAIKTFETIALAKTSTSAQEAKELNILTAEDQISINQDHLLYDAKKLVLTLSESGYRPPVKEKVPVTGETGYAALLLGAESLKLSGAISEHDMKIAKKLAFVIAGGRVPFGAEVTEEYLLNLEREAFLSLVSEPKSQARMQHMLVKGKPLRN

SEQ ID NO: 7507 - protein, 53 aa, Bacillus licheniformis
MVRERKNPSSAAVSAASIKGNAGPDYKKTDAGGKRTSQNQQYKKHNMDVPEDH

SEQ ID NO: 7508 - protein, 85 aa, Bacillus licheniformis
MQQQGMTTPPPVISTKDHLYLQDMLNWNLLAMKKAHFMADQCQDQSLKQNSTGSANAPSPLQYDIGAASSKSNAKPVSIHAIGGQ

SEQ ID NO: 7509 - protein, 113 aa, Bacillus licheniformis
MNQQNQQKIGNQETPVPKTSAMNDRDFVNELLTTEKYMTSAYSTALNELSHESLYQAVQPLFNEAQNAQRRLYQVMFQNGWYKVEAEDAQKIQQSYQQFHSTLQDQSPYQQNQ

SEQ ID NO: 7510 - protein, 83 aa, Bacillus licheniformis
MEKLREQLDGLVEKYTELLLGETDEELKEQVKMWIIYSHIAKSMPPLAKHWNGAYPDAKQGIKEVIRQIKERNEAHRAANQKK

SEQ ID NO: 7511 - protein, 246 aa, Bacillus licheniformis
MLNLTKEELESLLRFRLGTKQTGSLFSVKGNMLLDEDFLGRYAEAIKDRLNAPNQKVAASMLVKRGGMLAALHFYLFTVCGKRLPADPASVSWEIEADDQGWTPSFYFHKGAELIEGDRTEELKKLTEDIFRRHLGGMIEACRQTFSISKHILWENIAVYLYWMYDMLQEDPKLKARAARDFRFLLYEAEPGLFDEGEDENPLKRFYPGQHAEDRTRTTCCLYYATDENGVKCRTCPRNKHKERVS

SEQ ID NO: 7512 - protein, 272 aa, Bacillus licheniformis
MSAISTETLSLGYGETIIIDELNLTIPKGEITVFIGSNGCGKSTLLRSLARLMKPKGGSVLLEGSSIAKLPTKEVAKELAILPQGPSAPEGLTVLQLVKQGRYPYQNWLKQWSAEDEEAVQRALKATRMEELAERTVDSLSGGQRQRAWIAMTLAQETDIILLDEPTTYLDMTHQIEILDLLFELNEHEKRTIVMVLHDLNLACRYAHHLVAIKDKKIYAEGRPESIINCKLVQDVFEMDCEVTKDPLFGTPHCIPYGKGRCIVQQVVQSHA

SEQ ID NO: 7513 - protein, 346 aa, Bacillus licheniformis
MKNYRTLRIGKGGISLLIGRKALFSFVILLVLTACAVILSAGIGERFISPGAVAKTFLGMGDPGDDLIIMSFRMPRILVALFAGICLAAAGSILQGLIRNPLASPDIIGVTGGASVAVVLFLMLFSNKNNALTVSISWLPVAAFIGAALAGMLVYFLSYKNGSSTFRLVLIGIGFSMLAQSLTTLFMIKGPIYRMSQANVWITGSVYGSNWQDVNVLLPAALVLLLISAAAARNVNIQTLGEELATGAGSSVQRNRFLLLLLSTAFAGIAVAFAGTVGFVGLMAPHIARRLVGSSFGALLPVAALIGGLLVLIADIIGRTLFSPVEVPAGVFTAAIGAPLLYLLAV

SEQ ID NO: 7514 - protein, 333 aa, Bacillus licheniformis
MLLRTNKYRTIALLSFILVLAAAVCASIVYGYTNTSWSMAYKAFTGFSGSNEHLVIKNVRLPRALIAATVGASLGVAGALMQAMTKNPLASPGIFGVNAGAGFFVVGALFFFHVGSLQTIAWISFFGAAFAALVVYFVGSLGREGLTPVKLTLAGAAMSALFSSLTQGMLSVNEAALEQALFWLAGSVQGRDLSLLVSVLPYIVPAFIISFLLGSKINVLTMGEEVAKSLGQKTWLIKALMAVSIVLLAGGSVAVAGPIGFIGIVIPHFAKFIVGHDHRWVLPYCAVLGAILLVTADIGARYLIMPEEVPVGVMTAIIGTPIFVYIARRGFQK

SEQ ID NO: 7515 - protein, 325 aa, Bacillus licheniformis
MKRWSIVGFIALLAISILAACGGGKDDSAKGGENKDTITVKHAMGTEDQVPADPKRVVVLTNEGTEALLELGIKPVGAVKSWTGDPWYKHIQADMKGVKQIGLEGEPNIEAIAELKPDLIIGNKMRHEKIYDKLEKIAPTVFSETLRGEWKDNFSLYAKAVNKEEKGKEVLEDFDKKVSELSDKLGDQKKKRVSVIRFMAGQSRIYYKDSFPGIILDQLGFKYPEKQEKLFEKQDDKFVFMTENKESIPDMDGDVLFYFTYKPAESKKEAETWQNDWTSDPLWKKLNAVKTGNAHEVDDAIWTTAGGVKAAYLFLDDIEKYFLKS

SEQ ID NO: 7516 - protein, 148 aa, Bacillus licheniformis
MNQFRMAVIALVLILMTGCGSIAEEHAEGKEAVPDNAPVSDVKSVPYAAFALEVNYGHGKHNTFEAVYDKQEREEASIKDYLNGADREGEEALNEMKMVLSELSIAKSDPEQDVISNVLEAFNLDEQYDRFQLRVKWPDGTSRIYNGK

SEQ ID NO: 7517 - protein, 594 aa, Bacillus licheniformis
MTFHQLKDTWDLEVFFKGGSGSAEFRQYLNEIKTLLSTFKRSAEALTVSKSGLDELKETLALFETIDVKIREADAFVGCLQAQDTADLKANALNFEVTRLAADAQKALVVLDSKFAVVPNVEWEAILQDESISDIAYILNERRERVTEKLSSEQETLIQGLSVDGYHAWGDMYDSIVDQIQIPYEEDGETKILSVGQAQNLTSKPDRKIRRSVSENLDHGWEQHADLLSSTLNHLAGFRLNVYEARGWDNVLKEPLDINRMKQETLDVMWQVIIDHKKPFADYLSRKASLLGLDKLSWYDVEAPIGSAAKEYSYQEAAAFITGQFKTFGKKLSSFAEKALRDRWVEAEDRGGKRPGGFCANFPDSGESRIFMTFAGSQSNVSTLAHELGHAFHQESMLDVRPLNRAYAMNVAETASTFAEMIVADAALKQAGSDEEKIVLLEDKVQRSVAFFMNIHARFLFETRFYDERKNGVVSAGRLNELMEEAQKEAFCGALGEYHPYFWASKLHFYITSVPFYNFPYTFGYLFSLGIYAQALKEGAAFEEKYIALLKDTASMSVEELAMKHLGADLTKRDFWEAAIQPAVRDAEAFLAMT

SEQ ID NO: 7518 - protein, 384 aa, Bacillus licheniformis
MNVKRSLLFIIVLCLTLFFHSSAQAGEKNKPEIKSVSAILIDGKSGQVLYEKNSRKKMYPASITKIATAIYAIENGNLEDRVKVSKNAAQTEGSSVYLEEGESVPLKRLLQGLLMNSGNDAGTAIAEHLSGSVKQFADDLNAFIAEHAGVHDTHFMNPHGLFDKNHYTTSADMARITEYAMKNKTFRALFSEKQTDWHGQTWDTTLKNHHRMLTGEIPYKGITGGKTGFVDESKHTLVTTATRGSLDLIAVVMKADSKKMMYSDTKALLDEGFHNFETQELKKGEAFTDQNGTSHELKDPLYVTKKKGEVLSENVDTDGILNIKGEDGRLLQALQIAEPFSAEMTNGTDAIQGQPQSKGGLFLFVFGLIGLLTASYAVKRMRQL

SEQ ID NO: 7519 - protein, 280 aa, Bacillus licheniformis
MNNKIAIVTGATSGFGLLTALKLASTHFVIATARHPEKAEALRNRIAELSIESSIAVAELDVTNEQSISSFSEELKQYGQIDVLINNAGTAYGGFAEELSLGDYRKQYDTNVFGLVAVTKAVLPYMKKHSGAKIINLSSISGRIAFPAFSAYASSKHAVEGFSESLRLELRPFGINVAVVQPGSYQTAIWETSFAAQVTAPDAESQYKTYFERISAYIAASRKHYGNPDDVAELICRLAAKKRLNRLRYPIGRGVRLSILLHQILPWRIWERAVIKKLLK

SEQ ID NO: 7520 - protein, 154 aa, Bacillus licheniformis
MISQQLKQQNPVLENSMNTNLSNWFILYTKLHRFHWYVKGPQFFTLHEKFEELYNHASETADVIAERLLAIGGQPLATMKEYIDHGTIEENGAEKTAEEMVSALVSDYRQIRDEIQHTIELAEDKSDHSTADLYIALTEEIDKQIWMLSSFLDK

SEQ ID NO: 7521 - protein, 456 aa, Bacillus licheniformis
MDFRRDDEQKHANEEQFHEEAQTPQTAGSEEQQSEQPAKEPELILKKDTDDQSDLTNKETAAALEDARETRAAKEKRRKASWLSPILGGIIGGGLVLGISPYLPGDHPSETAGTGQTEPKQSQNFTTKPVTNADNVPDMVEDLEPAIVGVSNIQTSFGFSEDDVEESGTGSGVIFKKDGGKAYIITNNHVVEGASKVTISLYNGKTADAKIIGSDALTDLAVLEISSKGVDKVASFGDSAKLRAGEKVIAIGNPLGLQFSRTVTEGIISGVNRTIEVSTSEGNWDMNVLQTDAAINPGNSGGPLINSSGQVIGINSLKISQSGVESLGFAIPSNDVQPIVDELLEKGKVERPFLGVQMIDMQQVPEQYQQNTLGLFGDQLNKGVYIDKVSPKSPAADAGMKAGDVITKMNGKNVETTSDLRKILYTEAKAGDTVTFEVLRNGKQTTMKAKLAKSKS

SEQ ID NO: 7522 - protein, 224 aa, Bacillus licheniformis
MSYSIYLVEDEENLNELLTKYLESEGWHVTSFLNGESARQKIGQSPHLWILDIMLPDIDGYTLIKEIKNQDPEVPVIFISARDADIDRVLGLELGSSDYISKPFLPRELIIRVQKLLKLIYKEEPPEKKKGTPVSCYEVYEDLREVYENGSMINLTSKEFDLLLLFINNQGRAFSREDILTSVWGVDYFGTDRVVDDLVRRLRKKMPELKVETIYGFGYRMLKS

SEQ ID NO: 7523 - protein, 448 aa, Bacillus licheniformis
MKNRSLAFQIWSVICGILLTVSILLTFLFSTTLQNFFTDEIYTNIENEQHVLTEYGFSDSPERGFGGSSGSRSTNRHVQHVLLPEKGTVYQSPQILPDSFIEKVQKLGKRQDESSKRYSENVNGEHVFFVLKKIQTQDQTFLLLSYALDSYRDDLSHTLFKQLLFILIVVILLSWIPSIWLAKYLSRPLVTLEKHVKQISKQDWDDPVIVDREDEIGKLGHTIEDMRQKLIQKDETERTLLQNISHDLKTPVMVIRGYTQSIKDGIYPKGDLENTIEVIEGEAEKLEKKIKDLLYLTKLDYLLRQERQYGTFDIQEVIKEVVERLRWSKKELNWKIDLEEETMLTGDQEQWSKLLENVLENQIRYAETFIDISVRSTKEHTLITIKNDGPHIEEEMLSSLYEPFNKGKKGEFGIGLSIVKRILTLHHADMTIRNDQTGVCYSISVPRN

SEQ ID NO: 7524 - protein, 54 aa, Bacillus licheniformis
MKEIDDMIRRLRSRGIKVDKVKYPKHVLCEKKWMKKPKNTVKPSYRDFNGYSFI

SEQ ID NO: 7525 - protein, 294 aa, Bacillus licheniformis
MKQKEKVIIETAIKLFAKKGYSSTSVQEIAKECQMSKGAFYIYFKSKEALLLSVLHYYYERIFTRIQKIKTEHDNPRDVYRMQLVVFFENILEHKEFITMQFNERSMPINEEIEAFAKKMRRTTLRLHIENIQNIYGKDIEPYSAELCFMINGMSDVYLELMILLHHSFDLQSLADHMLNRLDDLAKGMIKRNDQPLIPFEKADEWFGPFYTFDPLKDALLNEMRVKANKQYNGAPPADLAESLDILEKELRKEKRKNAIIKGMIANLKEYPAIRKETDKLAELLKKDMHHPHG

SEQ ID NO: 7526 - protein, 462 aa, Bacillus licheniformis
MDYRIEKDTMGEVKVPADKFWGAQTQRSKENFKIGSEKMPQEIVYAFAILKRSAAIANEKLGNLEAEKKEAIVSVCDDILEGKYDSHFPLVVWQTGSGTQSNMNMNEVVANRGTAYLQEKGSSLKIHPNDDVNRSQSSNDTFPTAMHVAAVLAIHDKLIPAIDRLRSTLHEKAEAFKDIVKIGRTHLQDATPLTLGQEISGWVYMLDRSKEMILEAAEKIRDLAIGGTAVGTGINAHPEFGSTVAEEISALTGQTFKSSPNKFHALTSHDELTHVHGALKALAADLMKIANDVRWLASGPRCGIGELLIPENEPGSSIMPGKVNPTQSEALTMVASQIMGNDATIGFAASQGNFELNVFKPVIIYNFLQSVQLLADGMNSFHDKCAVGIEPNRETIEKNLTNSLMLVTALNPHIGYENAAKIAKLAHKEGLTLKEAALKLNLLTEEQFDEVVKPEEMVKPKA

SEQ ID NO: 7527 - protein, 55 aa, Bacillus licheniformis
MAQIRLTGKPEEIERIIQSFSKHYEVSYVSKEYGKTNPKYKYAKDTRVYIELKLK

SEQ ID NO: 7528 - protein, 480 aa, Bacillus licheniformis
MTQSEFKEHIHENLAMLLPHLEHNDDLIQNKKMLKNGIIFYFLYFKDLNDDKKIQKAAKLLVSDDSSYSLEDVRLRLNKLNAEPVTAKKDAINAIFKGKCLLLINGLNTVFALPTAEKKKRSLGEVNTENVVRGPKVGFIEDVDTNVALVRQRVPDKELTVEKIPLGKSKFKDATILYIQGKADDSIIKDLKKRLKKVQLDDIQDTGVLEELIEDNKYSPFPQIQNTERPDKVSSALFNGRIAIFVDYSPFALIVPASFGMVMQSPDDFYERWIATTLIRFLRFSSIFITLFLSAFYISLVSFHQGMLPTALAVTIASTRENVPFPPLLEALIMEVTIELLREAGLRLPNPLGQTIGLVGGVVIGQAAVEANIVSSVMVIIVSIIALASFTVPQYGMGLSFRVLRFISMVAAAVFGLYGIILCMLAIFTHLARQRSFGIPYFNPNHFFSLKHTDEAIIRLPTKAREVNRKNGSKKSARSD

SEQ ID NO: 7529 - protein, 366 aa, Bacillus licheniformis
MDPKNQHDRISTYEAASIITSTMLGAGLLTLPRALTQKTLSPDGWIVLIFEGLVFFLIIYINAKIVKKHNVLSFFDYTREGCGFIIGNILNLLIVLYFMGVASFEARAMAEMAKFFLLQFTPMSVTIFAFIVCAIYLVVGGISDMSKIFPFFLSVTIVILLIVCGLSLNMFQLNHLRPVLGLGLEPVSRALTVVSISFLGVELMMFLPKYVKNKEKLFKASAIGFGIPLFLYILTFAVVVGALTATEVMTLTWPTISLFQSFEIRGIFIERFESFLLVIWTIQFFTTFVVYTYFAASGLENVFGWPVKKNVLFIGVVIYLASLVPRDANQVSAFSDYLGYIFIVVFCALPLMIFLLVSIKRRFTSS

SEQ ID NO: 7530 - protein, 373 aa, Bacillus licheniformis
MKKKGMLAALSLLLLLTGCWDSRQIEKLSIAIGLALDKGEDDKNVKLTYQFLVPKKIGQDGSAQDPSKVVSTSGNTVHQTIRSTALKNFPVFSQHLQVLIFSEELVSDISLEALINQFIRDNSIRRSSEVYMTPGAADSILKVDGASDPASDVIHSISENRASTIKLLKPVTLNDISIKMQSDLSYIMPKVVIEKGQLQLEGGAVIKNNKYHANLSPSQIEALNLLTGNVIGGVIDSRHDGHLFSYEVFSMTHRVRAMRQNGKYKFVVNANIKGRLSEDWYLGEDSFNDQYIKNIEKSVQKDIKKRVEQLIHVLQHDIKTDVTDFSDNARINFPKEWEKDRFNWDKHFSEAYIDYHIKATIQDFGTKGATKSR

SEQ ID NO: 7531 - protein, 121 aa, Bacillus licheniformis
MTGIFLIAAAVILSGFIISDVAYDPFMEDSQSMLFFTIGTYLTTPFFCFIGGFILLGIGKLIDLQEKHNAIVAERLDIICQNGTAGEHAREENEAAQLTARTVETDSFTLPAAEDRKYWNG

SEQ ID NO: 7532 - protein, 207 aa, Bacillus licheniformis
MLIDDHEMVRMGLAAFLESQPDIEVIGEASDGKRGVELALETKPDVILMDLVMEGMDGIEATKQICRQLADPKIIVLTSFVDDDKVYPVIEAGALSYLLKTSKASEIADAIRAASVGEPKLEAKVAGKVLSKLRHSAGEQPLHQSLTARELEILKLVAEGKTNKGIAEELYITIKTVKTHVTNILSKLEVDDRTQAAIYAHRNKLVD

SEQ ID NO: 7533 - protein, 354 aa, Bacillus licheniformis
MRTNRLANIQWRAVRLSLGVSFTIFLAVLGFMLFYYQLDPRVLIVSRWFGIPFIALLALISTAVGFGSGYMFGNQLKKRLEKLIESILKYENGNFAYRIPSLGDDEIGLAADQLNEMAERIERQVASLQKLSNERAEWQDQMKKSVISEERQRLARELHDAVSQQLFAISMMTSAVLEGIDAAADEKLAQRLKMVEKMAADAQNEMRALLLHLRPVTLEGKGLQEGLADLLKEFKAKQSIDIDWEIEDAGKLPKGVEDHLFRIVQEALSNVFRHSKATKVTVRLLLRNKQLQLKVIDNGEGFKMDAVKTSSYGLNSIKERASEVGGVAEIISFTGKGTQVDVKVPIFEQQKGEA

SEQ ID NO: 7534 - protein, 243 aa, Bacillus licheniformis
MRLTKNQLIGLIIVLFGISIFLQNSGLGDALFWPLAFLFAGYFLHKYSRRWLGSVMYIFAGFLLLKDIFSITFSLFGFFFAAFLIYAGYRLVTNQPVFDRHKPKDRGKEKADFKPLQEKNSPGQRSFFFGDVKLMKTPFDLNDLNISGFIGDVKIDLSKAIISEGENTIVITGLIGDVDIYIPSDLEVSISSSAFVGDIDVIGGRKSGIGNQIYSETENYEQSARRVKISISLFIGDVDVRFI

SEQ ID NO: 7535 - protein, 287 aa, Bacillus licheniformis
MKKTVGKLLIIAGILILAGMMFNGREGFSFFGFDEESARTYHAQAEDIDKIDIDAKSITVNIQAENRDDIKAEISGKNVRLDSSEQGRTLQLSAHSKGFWPFFWKKNELIVKIPSEYKDDLSISSGSGNVKLSGGGLHLRNVALKSGSGSLKADDLQAEDLSVKGTSGSVRLENVQTAAADIRSTSGNTKLENVTGKLSIKQTSGNLRASFTEINDSLSIKQTSGNTKLSLPDDADISLEAESTSGNISHSYSFDQVANEKRTLTGKKGNGKNKIDISITSGNVSIE

SEQ ID NO: 7536 - protein, 227 aa, Bacillus licheniformis
MALKRIRDMFVASVNEGLDKLENPRVMLNQYVRDMESDIAKAKHTIVKQQTIEHSFKGKVEEAEKLAVKRRNQAQLAFDAGEEELAKKALSEMKYFEEKAAEYKDAHQHAKKQLAELKEQLETLEVKLRDIKDRKHALIARANAVKAKEHMNASFNKIDSESAYREFMRMENRIEEMETRVNSYAELSASSSSPFGRLEYAKEVEEELEKMRAKKTGLEKQTPAGNA

SEQ ID NO: 7537 - protein, 128 aa, Bacillus licheniformis
MNINGKSIIGFFLILFGVSLFFGGGHFGGLVTGAIGALLLFYSVKKWKEGRQFAAVLAAIFGIMFLGGSLPFLIGIAVAAAMVYFGWKMMKQDDKQDDILYSEKTEPSAASYDTGFDAEWEDFLKKNK

SEQ ID NO: 7538 - protein, 317 aa, Bacillus licheniformis
MVNREAAAIRLTVSKDGDGEFQTVQEAIDALPEYSREQKVIFIKKGVYKEVVHIPATKPFVKLIGENRYETVITYDNYAGKEKEGGGKYGTTGSSSVFIYADHVEAENLTFENSFDRTKVDTTDTQAVAVYAKGNRMTFKYVRFIGRQDTLFVNDGTQYFYQCYIEGDVDFIFGGARAVFEECQIHSADRGSATNNGYVTAASTHIAKPFGLLITNCRVTSDAADGTVYLGRPWHPGGDPDAIASVLYHRCDLGAHIKPEGWTDMSGFSAADARLYEYGNTGPGAISHEARRQLADHEAEKWTIENVLDGWNPKVES

SEQ ID NO: 7539 - protein, 192 aa, Bacillus licheniformis
MKLYTKTGDRGKTSLIGGRADKDHLRVEAYGTLDEANSFIGLAQSYLKAEEALFHDILSELTAIQHELFDCGSDLAHVNVQEEGKLKAESITMLEERIDAYVEEAPQLTKFILPGGTEAASFLHAARTVIRRAERKIVALAKEEDIPPLALPYVNRLSDYLFAAARIVNHRLGEVDVEYERSADVFRTKKKS

SEQ ID NO: 7540 - protein, 248 aa, Bacillus licheniformis
MEFNQQTAIITGASRGIGRAIAELLADKGANVVINGTNEELLKSLCTQLNTERKCASYVAGDASLPETASLLIAEAKQRFGRIDILVNNAGVNLRKTTVDTSLEEWKRVIDLNLTGTFLMCQAVIPEMITQGGGKIVNMSSTTSKTPHHNASPAYGASKAGINYLTMHLAKELAEHRIHVNGVCPGPIETDMSKQWSEEYRAAVVERIPLKMLGSPEHVANVVAFLASDKSDFMTGETININGGTYMN

SEQ ID NO: 7541 - protein, 72 aa, Bacillus licheniformis
MVAMYHDQGHGPIKVLGLEAGVNIAVGLPIIRTSVDHGTAFDIAGTGKADPASIEEAVRQAIMLSGTRERHA

SEQ ID NO: 7542 - protein, 331 aa, Bacillus licheniformis
MKTLYHFRTAARIEAGPHSLNLLGDYLDQIGLNQIRSVFILTQPSIVSLGYADQIKEGLAKKGISSEVNTDIQPEPTEQNIEQVFQLFSEGGHDAILGIGGGSVLDAAKILSVLKTNEKPISALIGTNLVEKPGVPLVLIPTTSGTGSEVTPNAIVTFPEKELKIGIVSPYLLPSLVILDPVLTTGLPKAITAATGMDAFTHALESYISNKANPFSDMFALESMRLISSSIQQAYHHGDNLEAREKMLIGAMYGGMALTSAGTAAVHAMAYPLGGKYKISHGVANSMLLPHVTAFNADHVTDRLSDVAGVIGIEPKGSKSSQAERVIRKIE

SEQ ID NO: 7543 - protein, 300 aa, Bacillus licheniformis
MKVEGIIPAILTPLTKEQAFHPGAAEKLVNRLIDSGVHGIFALGTNGEFHLFSQEEKLQIAETVVKAVNKRVPVFIGAGENSTEATISLFNQMADLGADVLSIITPYFVAPSQEELYQHFRTISENVALPVLLYNIPSRTGVSLEPETVERLAALPNIIGIKDSSGSFANIKAYLERTKEQSFSVLAGTDSLILDTLKAGGTGAVAATANVFPHTVVSIYESFKQGNIEESEHYQQQLQPLRDTFSLGSLPAPLKKAAELAGIDVGPPKRPIAELSGEPLLKVKKMLEGYGIEAKLAKEQ

SEQ ID NO: 7544 - protein, 427 aa, Bacillus licheniformis
MIDVIRVSGGYGKTDVLQDISFAVKPGEFLGILGPNGSGKTTLLKMLSGTIAPRSGEVLLECRSVGEYKTKELARKMAVLPQKTEQAFSFTVEETVQFGRYAYQAGLFRQLTAEDHDIVKRVMKQTDTLRFAQKSIHELSGGEQQRVYLAQALAQEPEYLLLDEPTSFLDLSFQKSLLDLMKQETAASKLAVVGVFHDVNIASLYCDRLLLLKDGKAEVLDRPEAALSAGRIGRVYDTDITGLDHPQRSNPQFTIMAKNIPRKTEPLFLKERIEQYLPHGIAFLADRPLRLLSSERGFAWRRKLIFDSGNNSGWPHGSSAFEQETLFIQHDAELADCHIVSESGDLCIVGMKDTMGRLIMWVLVDGCLQDGQFVKAISAAAFAAAQHHVPCSDVLVAATQSGRSADQTAFLTQIQNKTAACVKALKD

SEQ ID NO: 7545 - protein, 354 aa, Bacillus licheniformis
MLNIFTLTFLRNNRFAAYAFSLLFLSASVLMGISIGSLEIPIPSIMKVFLEEWFGIQGLNPDPTEANIIMKIRLPRVVLAALVGAGLAAAGAGFQGLLKNPLADPYTLGISSGAAVGAVVTLFFGIQLPVIGSFTLPFLSVAAAVIVIFLVLFFARLVHPSLTLSALILTGIIFSSFLGALISLMIALTGDDLKPIVHWLLGSVSMRGWGYVALFLPFFAAGAAALLISGRELNVMTYGEEKARLLGVNVKRSKYIVLLAGAILTGSAVAVSGTIGFVGLVIPHFIRLLSITDHRHLLPLSMLNGASFLVLSDLLSRTIIEPSELPIGIITALIGAPVFGFILIRRYRGGRVHD

SEQ ID NO: 7546 - protein, 316 aa, Bacillus licheniformis
MKKFGLLLLSLLLAAGVLSGCGQAQKPADEQKQEKAAEAFPVTIKDASGQEVKIEKEPKKIVSLMPSNTEITYALGLGKKVVGVTDFDTYPKEVKNVEKIGGMEFNTEKIISLNPDLVLAHASSMQSAEEGLKQLKDAGITVVTVNDAASFEETYRSIEMIGKAAGAEDQAASLVKSMKSDLAGIKEKAAAISKADQKKVFVEVSPAPDIYTTGKGTFMNEMLEAIHAENAASAQKGWAKITEEAIVKLNPDAIVTTNGESAVSEIKKRSGWSGVKAVKNNEVYDVDPDLVTRPGPRLIKGVEELAEHIYPDVFKK

SEQ ID NO: 7547 - protein, 226 aa, Bacillus licheniformis
MPIPKNYTPQVRLSAKEKAFHQLQRWIVDGTLEPGEKVTDVDLAEALGVSRTPVREALQLLESQGFVEMKPGKETKITLIHPDDALAVYPPLAHLQALAAELAAPLLTEEEIAELKKLAAQYETAFKEERNHDAAELDEQFHHLITEAAKNPYVLQFSAVLQLHVRRMKYVFFNRPAAPKMQSAAEHWKIIAAFEKNDPKLAAEVMKRNWLRPMEDIHKVLKGREQ

SEQ ID NO: 7548 - protein, 263 aa, Bacillus licheniformis
MDLKLKNKLVLVTGSTAGIGKATAEAFLAEGAEVIVNGRTEEKVQSVVDELSRHGNVHGIATDLSDPEESRALVEKTAEIGELDVLVNNMGFFEVKDFTDVTDEEWLKYFEVNVLSAVRLCRAFLPAMLKRNKGRVLNLASEAGIKPLPQMIPYSMTKTALISLSRGLAEMTKGTNVTVNSVLPGPTWTEGVANYMEGAAAQEKTDLDTFVKDYFKVNEPTSLIQRYAKPEEVASTIVYLASEKAAAINGSAQRVEGGIIRSI

SEQ ID NO: 7549 - protein, 231 aa, Bacillus licheniformis
MEYADILSINVGKPEEIQFQNKAVSTGIYKKPASGPIFLSSTNFTGDGQGDLIHHGGAEKAVCVYPYEHYLFWEKELQRKLEYGAFGENLTIKGLLEDDVHIGDIFQLGAAVVQVSQPRQPCYKLTVRYGMPDMILKVQDTGFTGFYFRVLKEGFVCKEHGLKRISRHPKGITISYANRIKHHEKNDIEGIKKLLEVEELSANWRASCLKRLNGFEPDDRERLTGGLKQGS

SEQ ID NO: 7550 - protein, 302 aa, Bacillus licheniformis
MELKQLEYFMALCRELHFTRAAEKLNIAQPSLSQQIRLLEHEIGMPLFNRSGKRTVMTEAGNILLQHCYNIFHELSQARDAISELQGLKRGTLKIGALLTVVNYLLPRTVVEFHRSYPNIELSVLGLRTGDIYDRLLQNELDLGIVAQRVEHRDLEAVPFLTQHLALAAPVDNPVAKRQFVTLDVLREIPSILLPETYFLRQLINEKCRTLGFEPRPVMEMTTMESIMNMVGKGIGATILPKGYLNAIGNKSIQTIPIQKPDLTTEISIVYRKNKHMCAASRVFMKLLISSVKSETADAPPR

SEQ ID NO: 7551 - protein, 436 aa, Bacillus licheniformis
MSLQKIKEEIVKKLKVPVFPNRSFDVTSFGADENGKNDSTEAIQKAIDQAHQAGGGRVTVPEGVFLSGALRLKSNVDLHIAKGAVIKFSQNPEDYLPVVLTRFEGVELYNYSPLIYAYEADNIAITGKGTLDGQGDDEHWWPWKRGTNGQPSQEKDRNALFEMAERGIPVTERQFGKGHYLRPNFIQPYRCKHILIQGVTVLNSPMWQVHPVLCENVTVDGIKVIGHGPNTDGVNPESCKNVVIKGCHFDNGDDCIAVKSGRNADGRRINIPSENIVIEHNEMKDGHGGVTIGSEISGGVKNVIAEGNLMDSPNLDRALRIKTNSVRGGVLENIYFHKNTVKSLKREVIAIDMEYEEGDAGDFKPVVRTVDVKQLKSMGGQYGIRVLAYDHSPVTGLKVADSEIDGVDVPMELKHVKDPVFSNLYINGKRYDSHKA

SEQ ID NO: 7552 - protein, 496 aa, Bacillus licheniformis
MKDCLMINPQDNVGIALRELQTGETVTVGERTIVIKEPILKGHKFALKDIAENENVIKYGFPIGHATEMIQTGEWVHTKNVKTNLGGVEEYSYKPKFTENRYQKEPLTFKGFKRKDGKTGIRNELWIVPTVGCVNGIAELIIKEFKAEVGSIAPFESVHVLKHQYGCSQLGDDHINTRTILANAVNHPNAGGVLVLGLGCENNSIHEFREALGDYDHSRVKFLLSQEVSNEVTEGVKLLKEIYKHAKGDHREDVPLSELKIGLKCGGSDGFSGITANPLLGRLSDFLIAQGGTAVLTEVPEMFGAETLLMERAENEEVFHKIVRLINDFKQYFIDHRQPVYENPSPGNKAGGITTLEDKSLGCTQKAGTSKVADVLEYGDVLKKKGLNLLSAPGNDLVASSALAAAGCQIVLFTTGRGTPFGTFVPTMKISTNTAIYEAKRHWIDFNAGKVLEDRSEDDVLKELTAYLIEVASGRQLNNEINDFRELAIFKTGVTL

SEQ ID NO: 7553 - protein, 489 aa, Bacillus licheniformis
MERLSKRIRSKPSRPERILQIGEGNFMRGFIDWQIHRLNEETDFNGSAVVVPPRRGSVTAFQEQDGLYTLYLEGFREGREVRDSAVITSISRVVSSYEHYDEFMELADLPDLRFVFSNTTEAGIIYIEEDRLSDRPQKSYPGKLTALLYRRYMTFQGSREKGLVILPCELLEDNGKILKDIVLRYTNAWALEQGFIDWLEEANVFCNTLVDRIVPGFPKENAHRLEEAAGYHDSLMVKAEPYHLFVIEGPKWLRDELPLHEAGLNVEFVQDVTPYRIRKVRILNGAHTAMTPVAYLAGLETVREAAEDELIGSFVKELIQREVLETIDMPDSELDNYVEEILDRFKNPFIRHKLIDISLNSFAKFKVRNLPVLMEYAERTGKLPARTVFALSALIYFYRGQRDGDDGAIPLSDDDEVLAFLKRLWTEETDVSNIAFHVLGFEKVWGQNLNDMPGLTDKTAEYLRDMKQTGMRKALEKMMKSQMAELGDM

SEQ ID NO: 7554 - protein, 332 aa, Bacillus licheniformis
MSVTIKDIARLANVSHTTVSRALNNSPLIKENTKKKILDIAAEMNYKPNFNAKSLVTQKSFTIGLFLTSLTDGTSSSFFADILRGVNKVIDENYNMVVRGIDDYHDLSSIHRNRYDGMILISQSEQDQAFIEHVLKQNIPVVVLNRKIEGHSVVNILANEHEGAFLAASYLIKNGHKQIAMVQGKEGFKSSQERKGGFLRALRDSNLDMPGEYLVQGDYTMQSGFRAAETLLKLKNPPTALFCANDDMAIGAMNALYANGKRCPDNMSIIGFDDSGFSAYTTPSLTTVKKPTEKISMLGAESLLSLIENPQAEGGQTLISTELIIRNSVKHL

SEQ ID NO: 7555 - protein, 462 aa, Bacillus licheniformis
MEISTNKQTETVAVTQEKLSLKEKVSYGFGDFGNGFMFDLGQLYLLKFFTDVAGIPAAAAGGIFLVSKLFAAFVDPIVGTSIDYRKNIGPKGKFRPYLLYGSFVLAILTILTFISPNLSPTGKLIYAYASYMLWGLGYSFVNIPYGSLGAAMTQNSVERTSLASFRQAGSLGALFVTSIVVIPMIVRFDNPAVAYPVVMGLMSFLGVLFFYICYRNCQERIVVKDEKYKQEKVTFKAISKTFFTNKPLLTLIFMTIFTISAYNLKSAMLIYFAQYNLGNAELMAYMNFIIIGSSFIGVIMLPKLVKLFGKKHTAILGLAVSVCADLINFFAPGNVFVFTILASIAFIGISIPNGITWAFVSDAIDYGEWRTGERKEGTVYSLFNFSRKLAQSLSGFLSGIGLSIIGYVPNAAQKAGTLLGIKAILLLYPAAALTAAILVLGYLYRLTDQKHAEMVAEIKART

SEQ ID NO: 7556 - protein, 473 aa, Bacillus licheniformis
MKPFLNDDFLLTNETSKVLYHQYAKGMPIIDYHCHLSPKEIYENKTFKNLTEVWLYGDHYKWRAMRANGISEEFITGDASDEEKFSAWARTVPMTIGNPLYHWTHLELRRFFGIDDRLDEKSAPHIWERVNEQLAGGGFGARDLIEKSNVETVVTTDDPTDSLEYHVKLKDEDFNVSVLPGFRPDKAMEINQEGFAAWVRKLETASGMKIANYDDFLKALKNRIDFFHEAGGRISDHAINQMMYTETDESEVRPIFAKVMNGESASPEEECKFKSLTLHFLGTCYAEKGWAMQLHINALRNNSSKMYRKLGPDTGYDAINDQDIAKPLCSFLDSLDRKDALPKTILYSLNPRDNVVISSLCGSFQDGRIPGKIQHGTAWWFNDTKDGMLEQMKSLANIGLLSRFIGMLTDSRSFLSYTRHEYFRRLLCDVIGTWVENGEAPDDIELLGRIVKGICYENAKHYFQFEVKDRLKA

SEQ ID NO: 7557 - protein, 585 aa, Bacillus licheniformis
MKLRGKLVLHFVSQIFLILGLVLATLLLSFIFFALRLSESEADTGLAKATSDTFESWVSVDDNNNWQIEDILKSAIDKQGGWLQILDGKEKTVYSYRLPAEIQRQYHREDLVSVFDKKRIKKYQVNFWSANFNGEDYVILFGWESKSDTILSYLEKEEKDMADLSSYKKSTLDFIKKNKGSVYLFSEKGKMLDSIYQDIDYSQGINELELLKYGSKPWNYEHEFSYRRLSATEWLIAATPNPIFNPDHEFNRTMIGLALKIVLIVIGVLILLMSSMTIWYSFRFGMPIIHTIKWIVNLSKGRFEEPRNRKGRPRSRNKKGKRKQPYRLFTEVFESMEQLTETLKKDEQNRKKIQTTREEWIAGLSHDLKTPLSTIYGYSMMLESPNYEWSKEEIREIGQAMKEKSDYMSQLIEDLNLTYRLKNDALPIKRQTVRLVPFLKSFVEEFKRHSFSEGYNVSFEYKQVDTEFAIDRGWFRRVLENLLANAVKHNKKGTDIKVILEESKQYIILKIQDNGRGMDSETVSNLFNRYYRGTHTKDATEGSGLGLAISLELVHLHDGCIAVDSRTGRGTEITMEFKKNPKAAK

SEQ ID NO: 7558 - protein, 242 aa, Bacillus licheniformis
MENATILIVDDEDAIVQMVKRVLTKEGFSEVLTASSAEEALDIVKKDTVHLILLDVMMPGQTGFDVSPEIRRHTNAPIFFLTAKTSDLDKLSGFAYGADDYITKPFNPLELIARIKAHLKRTYIHKEVAAASVSSAYEYERFIFHPDFAELIVDGETVSCSAQLLQLLQYFCDHPNRVLSKDQIYEKVWGVPSYGDSNTVMVHIRKLREKIEKDPSSPEYIVTIRGLGYKFVPNPARKESEG

SEQ ID NO: 7559 - protein, 270 aa, Bacillus licheniformis
MSLSTNNLGIGYGEQMIVENLNLHIPKGKVTTMIGPNGCGKSTILKTMARIQRSRTGAVYLNGKAIHQMSTKDVAKQMAILPQTPEAPGGLTVYELVSYGRFPHQKGMGRLSADDRRMVEWSLQVTGMLPFYDRPIEALSGGQRQRVWIAMALAQETELLLLDEPTTYLDLAHQLEILQLLEKLNQEEGRTILMVIHDLNHAARFAHHMVALNRGAIVKEGAPHEVMTSEVLKKVFQIDAEIILDPRTGKPVCLTYDLLKKEEDQRLATG

SEQ ID NO: 7560 - protein, 337 aa, Bacillus licheniformis
MLKKNNRRAGAVMLVMAVLTAAVFLLSMNMGEIRIDPLATLRTLFGFGTPQDELVLFEFRLPRMILAMLIGAGVAVSGAVWQGISRNDLADPGILGINTGAGFAVVLFIFYFQGDVGNLQKGFVFSLPIFAFLGACFAVVSIYLLAWKKGLNPIRLVLVGIGVNAAFSAAILMLQLKMDPNDFMQAAVWLSGNIWSSNWSFVSAVLPWIVVLIPFILYKARYLNVLNLGDQLATGLGTAVEKERRTLLLSAAALSGACVAAGGNITFLGLVAPHIARRLVGPKHQLLIPASALTGALLFLLADLIGRMILAPSEIPVGLVIAALGAPYFIYLLMKTN

SEQ ID NO: 7561 - protein, 354 aa, Bacillus licheniformis
MSSYKNIHHINGADGTDEEQRPISRPLGAVFVLAGGIMLLLFGAALSIALGAADIKLGTVWDAIFHFDAKNTAHQIIQELRLPRTVSAALVGACLAVSGAVMQGMTRNPLASPEIMSVTHGSAFAIAVAFAFFPGTSSIGLMIWSFAGAALGAGLVFGIGMFSKGGLTPVKLALAGTAVGTFLSALSTSIAIHFDVARDVSFWYAGGVAGTKWLSIQLLIPAAALGLAVVFVIARSITVLSLGEELAKGLGQYTKTVKAIGIVSVVLLTGATVSVAGAIGFIGLIIPHITRFLVGVDYRWIIPCSAVLGAVLLIYADIAARLVNPPFETPVGAVTALVGVPFFLYLARRERSGL

SEQ ID NO: 7562 - protein, 467 aa, Bacillus licheniformis
MEQTKKWGFWLLTAFVVGNMVGSGIFMLPSTLAQTASPLGVTAAWLVTGAGVLMIALVFGHLSIRRPDLKAGPQSYARALFSDPKKGNAAGFTMVWGYWVASWISNVAIITSLAGYLTTFLPILTDGRELVEFGGHPVTLGQLLTFIVCTILLWGTHFILVSSINGAGKLNFLATFSKVLGFVLFIVAGLFVFQTALFESFYFPIESEGKSIGLGGQVHNAAISTLWAFVGIESAVILSGRASSQRDVKRATITGLLIALGIYMIITLITMGVIPHDQLQASDKPFVDVLHVIIGSFGSVIMAVLAIVSLFGSMLGWILIGAEVPYQAAKAGDFPAFFAKTNKKGSPVNSLIVTNVMSQIFIFSTISGTISEAFTFLTTSATLAYLVPYLIAALFSLKLILKGETYGELKGSRTGDGIIALAALAYSLWVIVSGTSDLTTFILGIGLFFVGLAIYPFVYKKFKNNQV

SEQ ID NO: 7563 - protein, 156 aa, Bacillus licheniformis
MTGKTHIMGGVASCTAAAYFYGYDPVFMTASGVIGALIPDICHTKSKIGRRLPILSAVVSSVFGHRTFTHSLLFLLITAFAAHLYFADQSILVGLMAGMASHLLLDAGTVNGIKLFFPSAIKVRLPLYIKTGGKAEQVVLAVLTVVSCYFIANLIA

SEQ ID NO: 7564 - protein, 619 aa, Bacillus licheniformis
MKEQFFKKQWFLCLSIFFIWMKTYFIYKLGFNLQIDNALQELILFINPLSFLIPVLGISLFFREKSQRIYLIGANVVLTGILIANSIFYGFYIDFITIPVLFQAKNLGGLGSSFQELFNPVFIALFLDLALMVWLAKTRERTGKKLSAKAVKIYYAAAAGTVLFNLALSELDQPKFLSYSYDREVLVKNIGLYQFHLLDGISQTFNLTQKAVADENSLATIENYTNADYSKPNQDMFGIAKGRNVIFVTLESTQTFVINEKVNGQEITPFMNKFIQKSYYFDHFYQQTEQGKTSDSEFIVANSLYPSLSGSVFFTKSENAYNSMYKTLANHNYRTSVFHANHKKFWNRDVMYKALGIDSFYDVSHFHVTPENSTGWGLKDKEFLTQSADLMKDLPQPFYSNLITLTNHFPFQIDDEDKLIDEYDSESDILNRYVTTVRYEDEALKHFIAKLKKNGLYDNSVIVFMGDHYGISEAHNDALAQFLGKDEITPYDTVQLQRVPLIIHIPGVTDQDPKTISETGGQIDVKPTLLHLLGIDTKGMIQFGNDLFSKERMPFAVLRNGSFITDDYIYTKNTCYSKKTGDMINDGEDKCGPLIEKANEELSLSDKIINGDLLRFYKK

SEQ ID NO: 7565 - protein, 483 aa, Bacillus licheniformis
MSETQHKTNQLPIVAVLIMGTFIAILNQTLLTTALPPIMRDLNITPGLAQWLTTVFMLVNGIMIPVTAFLIEKFTTRKLFMAAMSLFTAGTLICALSFSFPALIAGRVVQAAGAGIMMPLMQTVLLLIFPKEKRGSAMGMVGLVIAFAPAVGPTLSGWIVDRYPWEVLFYLLLPFAVIDMIAAHFILKNVTEQTSPKMDVTSIILSSLGFGGILYGFSSAGVAGWTGADVLAGFAVGSVALFWFIWRQLHLEEPILEFRVFKYPMFTLATIIGMVVFMSMIGAATIVPMYMQDMRHFTAMESGMMLFPGAVVMGLMSPITGRIFDKIGARILSITGLTAIFVTTLLLTHLTKTTPFAYLSIVYAIRMVGMGMVLMPVTTAGLNQLPRHLIPHGTAMNNTMRQMSGSIGTAVLITIMTQRALLDPAGPSSDTAMIHGVNLAFMTAAALSGIGLVLSFFIKQHRRGRLDGSKRKQAKGRLAIHEK

SEQ ID NO: 7566 - protein, 279 aa, Bacillus licheniformis
MVSSLKDTVTLHNGVKMPWFGLGVFKVEEGSQVVESVKAAIKNGYRSIDTAAIYQNEEGVGKGIKESGVPREELFITSKVWNSDQGYEKTLAAFDESLRKLGLDYLDLYLIHWPGKDKYKDTWRALEKLYKDGRVKAIGVSNFNVHHLESLLEDAEIKPMVNQVEFHPRLTQTELRDYCKKQGIQVEAWSPLMQGKLLDDQVLTDIAKKYNKSVAQVILRWDLQNEVVTIPKSIKEHRIIENADIFDFELSAEDVEKINALNKDERVGPDPDTMVNGFE

SEQ ID NO: 7567 - protein, 286 aa, Bacillus licheniformis
MKHYGAIEAGGTKFVCAVGTEKGEIIDRLTIPTETPEETIGKLTDFFSKYQLTSMGVGSFGPISVAKNKEDYGYITNTPKLAWKGYPFIPELEKRLGIPVSFTTDVNAAALGELTKGEAQGLESCLYITVGTGIGAGAIVGGRLVQSTLHPEMGHLLIRRHPQDTFEGICPYHKDCLEGMASGPALEKRWGKKGKDLAENEEVWELEADYLAQALMQYILILCPEKIIMGGGVMKQQQLFPLIRKKLAEYLNGYVDLPDLEEYIVPPGLGDDQGITGALALAHSIG

SEQ ID NO: 7568 - protein, 374 aa, Bacillus licheniformis
MKHPFDNFRSLFPKLSDHVHLAACSGSALALPVAKAVDEYQNGLLTAGADWKAHLDKMDETKEKFARLIGAEKEEIAVLPSVSDAVAAVAAAMPQPPRRRQIAFTDIDFPAVGQIWLAQDRFKDHLIIIQSEDGMIDLEQYEKDVTDQTLLTCVPHAGYRNGFKQDIKQIAEIVHQKGSLLFVDAYQTAGHIPIHVKDMDIDILAAGTRKYMLGIPGTAFLYMKRELCEQFEPKTAGWFGRSAPFALDSGFAEGAKRFESGTPSFISIYAADAALKLLLEAEPDRIEPYLRQLAAFSLQYGAEKGLKITGPNTVHNRTSLISVYAEEAARVESLLREKHIIVSKRNNVIRIAPHFYNTKEEIGFVMDEIAAIVG

SEQ ID NO: 7569 - protein, 136 aa, Bacillus licheniformis
MELYIEGELEEHRKLPHRKVLFAILAVLLGSGITIGYIVYTHFYSMNHLPKGNWFQSSGSPNQAYNLNLYRVNKGGGTNSPSVRGELTTVATGERKNIYWGYEEEHAKIEWQDKYHVSINNNVLDVRTDIYDGRRE

SEQ ID NO: 7570 - protein, 776 aa, Bacillus licheniformis
MQENGQEWLEEEKRIRLVLKELDQKLHSLKGKTGGLKEDIIDLRKHFWSDVTVNIADENEAVETFFSIKQQAEVLAERERSHKQFYSQLKNLLKVKESPYFGRVDFLEDGEENAESVYIGLASLMYEKEERFLIYDWRAPISSLFYNYGPGAAQYEVPDETVRGTIELKRQFLFKNGQLKAMFNTDMAIGDEVLQEVLGQQADIQMKSIVATIQKEQNQIIRNEKSRFLIVRGAAGSGKTSAALQRAAYLLYRGRGQIESSQMLLFSPNLLFNSYVANVLPELGEENIQQTTFQEFVARRLGKQVPCETPFDQLEYCLTASDGEEQRIRMKSIELKSSLAFKGIIDDYVKYLAKGHLVFKHITFRGKRIITSGQMRKFFAALDHSDTLSNRIEQTGKWLLQLLNKYERQERKKDWVIEESELLDKEEYLKAYKRLQEEQRFTENTFDDYERERNLLASIVAEREFKPLKQVVKAFGFIDFKGTYLQLFSGRYTPQTRPDDWQSICTFTQKSFRFEKLLYEDAVPFLYMKNKLKGGGKNTAIRHLFIDEAQDYTPFQLAFLESLFPACSITMLGDLNQAILAHAYHDKTLLSGGVFEGEKTEIITLKRSYRSTKEIVELTKRIIEGGEEIEAFNRNGKKPTLTISADPHAHHKEMASLMTALQKEGLETIAVICKTVRECRDAFQHLQQHAELKLIDKETRTFQKGVVVIPVYLAKGIEFDAVIIYDASEKQYKKERERTLFYTACTRAMHELHLFSIGKETHFLNGVPNDMYTRRE

SEQ ID NO: 7571 - protein, 202 aa, Bacillus licheniformis
MAWEVLSIIGTVAFAISGAIVAMEEEYDILGVYILGIVTAFGGGAIRNLLIGVPVSALWEQGSLFLIALVSITIVFLFPKLLLKHWSIWGSFSDAIGLAAFAIQGALYAVHMNHPVSAVIVAAVLTGSGGGMIRDLLAGRKPLVLKTEIYAVWAALGGFIIGMGWAEKPLTLYILFALLVACRVCSYMFNWKLPNRSLRSHS

SEQ ID NO: 7572 - protein, 116 aa, Bacillus licheniformis
MGQEVIIEKAKAEWAHEFEAEKQQLADVLGKKVLAIEQIGSTSVPGLAAKPVLDLMAGVSSLSEASVGSNRFRSSAMSTYFTKPSQPGVFFERESGGRAHAICTYTFFKAKNGKIS

SEQ ID NO: 7573 - protein, 161 aa, Bacillus licheniformis
MECKIRKMKKKDIPQVQQIAKTSWNHTYEGIIPFDIQEKFLQKAYNDERMQQRLEHSLMLVSEADGKIVGFANYSFVREGGVAYLAAVYLAPEYQGKGIGTALLEEGMNHLKGVKKIFVEVEKENRTGKNFYKAKGFEDVAEYDEDFEGHILKTVRMALHV

SEQ ID NO: 7574 - protein, 137 aa, Bacillus licheniformis
MKNKLLFLYGAWIVSLTATLGSLYFSEIRKFIPCELCWYQRIMMYPLVLILGIATFQGDARVKKYVLPMAVIGAGISLMHYMEQKIPGFNGIKPCVTGVPCSGQYINWFGFITIPFLALIAFILIIIFMCFLKGKDE

SEQ ID NO: 7575 - protein, 231 aa, Bacillus licheniformis
MKKKQQSPMKFAVIMTVVVVFLIGALVVINNQTQNASQTFDDKPSTEGQPLLGNKDAAVTITEFGDYKCPSCKQWTETVFPDLKKDYIDKDQVNFSYINFVNEQHGRGSELSALASEQVWKEDPDSFWKFHEALYKAQPDNDTMENEWATPAKLADITEANTKIKRDKLVSSLNDKTFAEQLKTDNSLINKYGVDSTPTIFVNGVKIDKPFDYDKIKETIEKELKGQSDEK

SEQ ID NO: 7576 - protein, 703 aa, Bacillus licheniformis
MEKVKQEYTLNGLDCSNCAQKIEHEIAGMKGIEACSVNFATSTLTVQVDQNSGEDISLIIKKKVTEIEPHVNATLKEGTKQAPPESDGRFKKTVARLAAGTVLGAAGFLLPGGTAAEWLLFFLAYLIIGGDVVLRAVKNIFRGRVFDEHFLMTIATLGAFIIQQYPEGVAVMLFYQIGELFQGAAVTRSRKSISDLMDIRPDYANLQTEGGTVKVSPDEVKAGDIIIVKPGEKVPLDGKVRAGKSLVDTSALTGESVPREAAPGTEVLSGFVNKNGVLEVEVDKEYSESTVSKILDLVQNASSRKAKTENFITKFAKYYTPFVVIIALLLAFVPPLIISGALLSDWVYRALVFLVISCPCALVVSIPLGFFGGIGAASKAGILVKGGNYLEALNDVKYAVFDKTGTLTKGEFAVVKLSPASHVKEDELLEYAALAEHFSGHPIAESIREAYGKEVQADRIKDYSETAGFGVRAVVDGAVILAGNAKLMKKAGIQYQKESEIGTVVYVAAGDTFIGSIVIADEIKEDAKRAISALKKAGIKKTVMLTGDAKDTGEAVGEQLSIDEVHAELLPQHKVDRIETLDKQKLPKEKLLFAGDGINDTPVLARADIGVAMGGLGSDAAVEAADIVIMTDQPSKIAEAISIAKRTRTIVWQNIIFALGVKGVFLILGAFGIATMWEAVFSDVGVTLLAVLNAMRVLKVKEM

SEQ ID NO: 7577 - protein, 404 aa, Bacillus licheniformis
MKKSCLMIVCLAFLLAFSAGCKSSTGTKHTEEIKVWDYFTGKQQDLYHELVEQYNRSQDRYKVVTEYIPFNEVKKQLSVGTAGNAMPDAVFLDNVDNASFAAMGVLEDLTEKIEQWGQADQFYEGPLSSAGYEEKYYGIPFASNALALFYNKDLLKNAGISKPPETWSDLKKAAEKTSKGQTKRFALSAVKSEESAFQFYPFLLSSGADLKQLNSKEAASSLQFLTDLIKKGAMSKEVLNATQDDLARQFAAGQLAMMINGSWNIERLEEAEDLNYGITYIPKDQTFASALGGENIAVVKGKNTAGAWDFISWLIDPERLETLTAETGVFPPRKDLLESSSHWKTDDNLKAFIPIIEIASARGPSKDWPKISEALQTALQEALSESKTPKEALDEAAQKISALN

SEQ ID NO: 7578 - protein, 297 aa, Bacillus licheniformis
MIRAIVRKWEGYFYLFPAVLFMLALIGYPLIYNMILSFQNVSLANIASHDISFIGIENYQRLAQDKIFWASLKNTLLYTAGSVVFQFAIGFLLALFFSMKFRLAPFLRGLMMVSWLIPLTVTALLFKFMMASNEGVFNQLLLSWGMIDTPIPWLSDPNMAIWSVIIANIWVGIPFNMLLISAGLSSLPEDVYESASLDGANAFQKFIHLTLPLLRPVITVVMMLGFIYTFKVFDLVFVMTGGGPVDATEVLSTVSYRYSFDEFQFSMGAASANVLFLILLLVSLVYLRLIKKDEVMS

SEQ ID NO: 7579 - protein, 273 aa, Bacillus licheniformis
MKTNQKEWLFNIIGVLVTAGFLFPVYWMIATAFKSDAELFKTPPLLWPETFRTAGFEAVFTSGVAGYFLNSLLISGAAAVIVLILAVPSAYGLARFRIKGKKMFILLFLITQMLPATVVLTPLFIAFNQLNILNTYIGPILTGATLGVPFSVLMLRTFFLGIPKDLEDAAKIDGCSRFTAFIRIILPISVPGIAVSGAVSFFFTWGDLIYSMTFNRNQELWPLTAGIYNVISQYGIQWNDLMAFAVLSVLPVIIIFMLLQKQLVKGLINGSIK

SEQ ID NO: 7580 - protein, 769 aa, Bacillus licheniformis
MKFSDGYWLTREGYHINTPKEAYDRMIDQQSLTVYGPVKAVQKRGDTLDTRMLTVRFSSPLEDMIRVQVFHFQGETPRKPDFQLHTADVEPVITEHDDALTFQSGSLCVEVSKNGWGYQFSRDGQSLTASESNSLAYITSDDGRTFMREQLNIGVGELLYGLGERFTAFVKNGQTVDIWNQDGGTSTEQAYKNVPFYLSNKGYGVFVNHPELVSYEIGSEVVSKAQFSVEGESLDYFVISGAEPKDVLKRYAALTGKPALPPAWSFGLWLSTSFTTDYSEETVTRFIDGMTERGIPLSVFHFDCFWMKEFEWCNFEWDERYFKQPEAMLSRLKEKGLKICVWINPYIAQKSKLFQEGKENGYFLKNSRGDVWQWDRWQAGMAIVDFTNEKARDWYCSKLESLLDMGVDCFKTDFGERIPSDAVYFDGSDPERMHNYYSYLYNKTVFDLLRQKRGEREAVVFARSATAGGQQFPVHWGGDCFASYDSMAESLRGGLSLSLSGFGFWSHDIGGFESTATADLYKRWTAFGLLSTHSRLHGSESYRVPWLFDEEAADVMRYFVKLKHRLMPYLYAAAHEAHAEGIPMMRAMLLEFPGDNTCHWLDRQYMLGGRLLVAPVFQEDGAVRYYLPKGTWTHLLTGKETEGGEWKEERYGYMRLPLFVRENTLLPLGQESGRPDYDYLDDVTFCLYHLKDGCTAEQTIYNEKGEAMTLRASRHQNTIAVKTTGVQKNWKLLLRGLSVTSVINGAAEALQEGTAVQPKEKERDVFIYF

SEQ ID NO: 7581 - protein, 981 aa, Bacillus licheniformis
MLKTVRIIILGAMCTILSAAGFDPPQPAAAKSQADEYEYPFQDPSLPVQKRVSDLLSRLTLEEKVSLMHQYQPAVPRLGIPAFKTGTEALHGVAWLGEATVFPQAFGLAHTWDRYLIKQIGSAVGDEVRGFHHLDPAANGVNVWAPVVDLLRDPRWGRNEEGYSEDPFLTGEIATAYASGLRGDHPFYLKTVPTLKHFLAYNNETDRGFSSSSIDPRNMHEYYLKPFETAISKKAAYGLMPAYNSVNDKPAILSPLLDSTVKRRWAGDDFFIVSDAFDPSGIVNDHKYYDSHEKAHAHAVKAGIDNFTDQGENPELTRNALTGALKQGLISEKDLDQALANTFSIRFRTGEFDPDELNPYSRLTDDVINSPKHQLLAKKAAEKAIVLLKNDQDLLPFNARKNESIAVIGPFGNALYEDWYSGTMPYRKTPLDEIADKIGKDRVSFAEGLEQSGFKSALTGKFVTAGRDGKQPLTAAADKLEKSAAFDAADWGESIFTLRAQANGLYVSLQDDGRLIADQKQPNGRTVKETFQFEQQSDGTFAIKNTANGKYLTAGKDGTLTAAAEKPATAAEKFSKTIIKSGTDEAVQLAKSADKAIVFVGNNPYINGRETEDRKDITLPPAQENLLKAVSKANTNTVLVVTSSYPFALNWAKAHIPAIIYSAHGGQEAGSALADILYGDVNPGGRLTQTWHTSVKELPDMMNYDIIKGKRTYKYFVGKPLFPFGHGLSYTAFRYSDLSLSSDSIKKDGSVTIRVNVTNTGGRKGDEVVQLYTSPLFKTRVKQPNLDLKDFQRVELAPKETKTVTFKLKQTDLAFWDVTRETFAVERGPYRISVGSSAADIRKTKRIFVQGETIRERNLRRKTNAEDYDDYKGVLITEESKYGGDAVKSSTTNAWIAYHDVRFKGEKRIEAKVASSGAGEIGIFLDHPQKGKQIGSLKVPDTSGLQNWKTVKASVRKSTGTHRVFFVFKGKVAIDSFQFER

SEQ ID NO: 7582 - protein, 247 aa, Bacillus licheniformis
MKPAITVKDLYVSYHGAEALRNINFSLDQGMMAGIIGPNGAGKSTLLKSMLQLIPKDKGDVRLLGKPLKDVRKQIAYVPQRNDMDWTFPINVLDTVILGTYPELGLFRRPKKRDKDWAYHCLEKVGMAAYAKRQIGELSGGQQQRVFLARALAQKAELFCLDEPFVGIDVTSEEMIVSILKELRDEGKTVLVVHHDLSKADSYFNELILLNKELIQKGPVSDILNPDVMMKAYESQLPFLQSKRGAI

SEQ ID NO: 7583 - protein, 286 aa, Bacillus licheniformis
MEFIHGLMEYSFLQKSLFTSIMVGIICGVIGCFIILRGMALMGDAISHAVLPGVAISYMLGVNFFFGAVFTGILTALGIGYVSQNSRIKNDSAIGIVFTAFFAVGIILITLVKSSSDLYHILFGNVLAVRSSDMWITLVIGVIILTAVFLFYKELLITSFDPTMAAVYGLPNRLIHYFLMTLLTMVTVASLQTVGIILVVAMLITPAATAYLLTDRLWVMIYLSAFLGALSAVIGLGLSYTYNLSSGAAIVLVATILFGLSFTFSPKQGVLWRAVKSRRKRAALQQ

SEQ ID NO: 7584 - protein, 309 aa, Bacillus licheniformis
MKWKQTLAIAAALILILAAGCSSKSSSEENGKLKVVTTYSILYDIVKQVGGDHIDLYSIVPVGTDPHEYDPLPKDVQKTTDADVVFYNGLNLETGNGWFNKLLETAEKDGDDAPVYKLSKGVKPKHLTAKGKETEEDPHAWLDIENGIQYAKNARDALIKNDPDHKEDYEKNAEAYIGKLQKLHDEAVNRFKDIPKERRVLVTSEGAFKYFASAYGVDAQYIWEINTENEGTPGQMKKIVDTVKKKDVPALFVETSVDPRSMESLSAETGVPIKAKVFTDSIGKPGEAGDSYYKMMKENLDRIHQGLAE

SEQ ID NO: 7585 - protein, 108 aa, Bacillus licheniformis
MKSGYEECIKACRECLEACNHCFDKCLMEEEAGMMAECIRLDRECAEMCGYAIQAMTRNSPYAEDICQLCAKVCEACGNECSQHKHDHCQFCAESCFACAEACRKMAS

SEQ ID NO: 7586 - protein, 259 aa, Bacillus licheniformis
MKDSVFQMTSDTYQSLSDSERHLLEYIYQHLDVIATLSIVKLSEDANVSTATIVRLMKKLGYDGYTSFKYALKEKHHLGHAPLMDDIDSQIKQAVLKNEREVLDTIKMLDIGLIEDAIQKISNAEKVYIFARGLSEMIGTEMTIKLQLLGKNCEMHSDPNIIRGKSKTLAKKDLGLFVSLNGETEELVEAAQNFKLQAISTITLTTRIDSRLAKLSEIVLVGFKGEQSFFPDYEVRSRLPLQVLSRIMLDSYVIRTAHS

SEQ ID NO: 7587 - protein, 304 aa, Bacillus licheniformis
MIYTCTMNTAVDLFVETDELLPDVVNRTKDEDYQPNGKGVNISFMLKRLGLDNTALGFTGGFTGRFIENELLNEKIVTDFVEVEGISRINIFINSTREFKIVNKGPLISEARKQELINKIRQIPPGRFLFISGSLPRGVPDDMYLSLSEIAAENKLKLILDISSPVLLDCLSYHPYLIKPNEQELAAFFSRKKALSEEEIIHCGKELLDRGAERVLISRGKDGALYLDRQRTLKATAAKGKVVNTACAGDAMLAVFVGKQELGCSVPEALRHASAAGSLTAFSKGLGDVSKLDQTASQIQITHL

SEQ ID NO: 7588 - protein, 466 aa, Bacillus licheniformis
MKKFKIIAATGCPTGIAHTFMAEEALKQAAAKLGVEIKVETHGQIGVQNELSPEDIKQADGVIVAADKDVGAERFAGKRVLDVPVARGIRDAESLIRTLMNGEAPIYRGQTAAKTEDEPKTGESASIGRKIYKHLMNGVSHMLPFVVGGGVLIALSFLFGIHSADPEHPSYNAFAELLNKTGAFGFQLMVPILSAYIADSMAKRPGLIVGFIGGMIASTGGAGFLGGIVSGFLAGLIIYGLSHALKKMPQSLEGLKAIFLYPVIGIFLIGAVMFFLVEPMTAINEGMKGFLADFQGANPIILGLIIGCMSAFDMGGPVNKAAYVTGTALLAEGNQYFMAGVSAACITPPLVIAFATLLFRKYFSQQDRNAGLVNFILGATHITEGAIPFAAKKPIPVIPILMIGSSVSAILTYSFAVQVPAPHGGFLVLPVVTGAFQWVLSIIIGSLIGAFLYGFYQKRTYEKEKG

SEQ ID NO: 7589 - protein, 152 aa, Bacillus licheniformis
MKTAALIKKEHIYLQETLSSQAEAFDRLAQIAYESGAAKTKQAVIDGLAQREAESTTGFIDGFAIPHAKLKDITEATVIIIQNKAGIEWNALDQTPVTFIIALLIPDAEAGSTHLNLLSSVSRMLVHEDARQQLLEASSPDDILSTFSSYLS

SEQ ID NO: 7590 - protein, 283 aa, Bacillus licheniformis
MLTNTKKMLLDAQANGYAVPAFNIHNLETVQAVTEAAEALRSPVILAATPGTFSYAGRDYIQAIAETAAARCSIPVALHLDHHEEIDDIRESLSLGTKSVMIDASHHPFAENTAITASVVQYARQKDATVEAELGRLGGQEDDLIVDEADAYYTDPDAAKEFVEKTGIDSLAVAIGTAHGLYSKEPNIDFERLAAIQKRVSVPLVLHGASGISEQDVRKCIKLGCAKVNIATELKIPFSDKLRRYLHEHADASDPRKYMAPAKEAMKKIVQEKILMCMSNDRY

SEQ ID NO: 7591 - protein, 54 aa, Bacillus licheniformis
MEESVLKDKTVLVWTVSAVVYVGIVMLVYSILAGREPIPDEKPHDGHALEEHVK

SEQ ID NO: 7592 - protein, 814 aa, Bacillus licheniformis
MKDMDGQKEATLQISGMTCAACAARIEKGLKRLDGVQDANVNLALEKSKIVYDPGQIEVGQLAEKVESLGYQVPAEKAEFAVSGMTCAACANRVEKRLNKLSGVKSAAVNFAIETATVDYHAGAVSPEEMIEAVEKLGYKLELKKDRTADGRAEQREKDIQRQTGKFIFSAILSFPLLWAMVSHFKFTSFIWLPGMFMDPWVQFALATPVQFIVGKQFYTGAYKALRNKSANMDVLVALGTSAAYFYSLYLSIESLGTNRHPDGLYYETSAILLTLIILGKLFEAKAKGRSSEAIKKLMGLQAKTATVVRNGEEMTVPIENVLAGDIMYVKPGEKVPADGEIVEGRSALDESMITGESIPVDKTVGDPVIGATINKNGFLKVRAEKVGKDTALAQIIKVVEEAQGSKAPIQRLADRISGVFVPIVVAIAAITFFIWYLAVSPGEFGTALEKLIAVLVIACPCALGLATPTSIMAGSGRAAEFGILFKGGEHLETAHRLETIVLDKTGTVTNGKPQLTDVRPEPWIDETSFLKLIGAAEKSSEHPLAEAIVEGIKEKGIEPASADSFEAIPGYGIEAAVNEKRILIGTRRLMENRDIDIQDANGEMEELETQGKTAMLAAVDGRFAGLIAVADTIKDTSKAAVKRLHDMGLEVVMITGDNRRTAEAIAAEAGIHHVIAEVLPEGKADEVKKIQAKGKKVAMVGDGINDAPALAAADTGMAIGTGTDVAMEAADVTLIRGDLNSIADAILMSRLTIKNIKQNLFWAFAYNSIGIPFAAVGLLAPWIAGAAMAFSSVSVVLNALRLQKVKLDWRNPS

SEQ ID NO: 7593 - protein, 69 aa, Bacillus licheniformis
MEQKTLKVEGMSCNHCVQAVEGNVGKLGGVESVKVNLNEGKVEVSFDSGKVSLKEIIDTIEDQGYDVAG

SEQ ID NO: 7594 - protein, 100 aa, Bacillus licheniformis
MADHHEHALNPKSSKGKEQITNRLKRIEGQVRGIQKMIENDRYCVDILVQISAVQAAMQKVAFSLLEDHTHHCVANAIKSGEGEEAIEELLDVFKRFSKS

SEQ ID NO: 7595 - protein, 183 aa, Bacillus licheniformis
MAKKILIVTGDAVEALEVYYPYYRCLEEGYETTIAAPKKKKIHTVVHDFLDWDTYTEKPGYLIDAHASFDEIDPSEYDGIIIPGGRAPEFIRMYDSLLKIVAHFFEENKPVGAICHASLIFTSLREHLKGRELTAYIACKPEVEAAGATYVEEKLHVDANLVSGHDWSNLPEFMREFFKALNK

SEQ ID NO: 7596 - protein, 253 aa, Bacillus licheniformis
MLVAERHQKIVELVNLRSSVRVTELSELFSVTEETIRRDLEKLEKENKLKRSHGGAVSVQTEEREVHFREREITNVNEKKMIAFEAVKHVKSGERIILDASTTAWYMAKALENIPLTVITNSVRVAIELSKKEKVTVISTGGMLLPQSMSYVGPLAERSLDMYHVNKTFLSCKGVDPASGLSDSNEMQALLKKRMIEIADETILMADSSKFGTRAFSQIDRLHDRYRVITDSGIDKANLARLKDITENITIVG

SEQ ID NO: 7597 - protein, 493 aa, Bacillus licheniformis
MTILAFDLGASSGRAYAGHVDGGLIKAEEIHRFPNQPVQAGKHLYWDILRLYHEIKQGILKAKNGCGRISCIGIDSWAVDVGFLDRNGELMGNPYHYRDPYTDGIMTEVLNEIGKEELFSRTGIQLLPFNTIFQLRALKKANSPLLDYADTLLMIPDLLRYFLTGEKKSEFTNATTTQLFNPKTSDWDWELISLLGIPAKIFPKDIAKPGSEAGRLSQSVCGELSVPAVPVIAVGEHDTASAVVGIPAETDDFAYLICGTWSLIGTELDAPLMTKQALDWNFTNEGGAGGTFRFLKNIMGLWLFQRCQADWEKDGISYSSAELVKLAGQSEAFRSAVDPDDPVFLNPVHMPEAIREYCRAAGQHVPETPGQIIRCVLESLAFKYRFTFERIETLTGKEYDGLHMAGGGIRNELLCQYTANVLSRNVWAGPSEASAIGNIAVQAVALDMFWDIQSARKAIKASFPQKTYVPEDTEAWERAYRRYTSQILGAASR

SEQ ID NO: 7598 - protein, 407 aa, Bacillus licheniformis
MMNDRAYALFEEQQKDRGISLSEAKEKLKALKIETPSWGYGDSGTRFKVFQQEGVPRDPFEKMEDASVVHKLTGICPSVAIHIPWDRVDDYGKLKAHAEQLGLAIGAVNPNLFQDDDYKFGSVTNVKAAIRQKATEQLLECVDIAKQTGSKEISLWLADGTNYPGQGDIRKRKNWMYECLAEVYEALDDDMRLLIEYKFFEPAFYHTDLADWGMAYNLAQKLGPKAEVLVDTGHHAQGTNIEHIVAYLLDEKRLGGFHFNSRKYADDDLIAGAHNPYELFLIFSQILDACRDSDPNVRKTAEHISYMLDQCHNLEPKIPAVLRSVMNVQTQFAKALLINFDEVKKAQEDHDVLAAEAAIREAFEIDVKPLLCAVREEMNVPPDPLKAYAESGYAEKILARGKGGASW

SEQ ID NO: 7599 - protein, 129 aa, Bacillus licheniformis
MKGETHWIIPDGFIPPESSGSLTSHEAICVLNCHEENANLAITVYFEDRPPLEGISETVHGKRTKHIRTSSLHRSGERIPENVPYAIEIASDVPVIVQYSRLDTTQPELALMSTMAYPLKTRGMGVHDE

SEQ ID NO: 7600 - protein, 689 aa, Bacillus licheniformis
MVKYLWSESEAASLRPGLAELVYRSNLIGADRSVCNWGGGNTSMKTTEKDFRGRDIEVMWVKGSGSDLATMSAGQFTGLRLDDIRPLMERSSMTDEEMTAYLSHCMMDGKHPRPSIETLLHAFLPFPHVDHTHPDAIISICCCDNGKEIAEEIYGSRFVWVPYVRPGFALSKMIAEGVKNNPNAELVLMEKHGLVTWGETSKESYDQTIAVIREAEAYIKSRSEDHQPFGGQMVEPLAPEERKRILADILPVIRGAVSGEKRMLVTWCDADDVLEFANSRRAPSLSQVGAACPDHLVHTKRVPAYIPWNPAEQDTEALVDRIKTEIAGFKESYAAYFQRNRHEGDEMFEPAPRVMLIPGIGMVTAGKSLAMAKVSRDLYRRAIAVMKGTEVLGNFVSLNEEESYNVEYWPLELYKLTLAPPEAEFSRKIAFVTGGAGGIGSEACRRLALEGAHVVVADINIEGAEKTAAEINDQYGAERAYAVRMDVTKEEEVQTAFEEIALKYGGIDILVNNAGLATSSPLDETTLEEWNLNMNVLGTGYFLVAREAFKQMKKQGSGGSMVFVGSKNSVYAGKNASAYSSAKALEVHLARCIAAEGGPYGIRANSVLPDAVLQGSAIWDSKWREERAAAYGIEPDRLEEHYRKRTALSVNIYPADIAEAIAYFASEKTAKTTGCMLTVDGGVPAAFSR

SEQ ID NO: 7601 - protein, 372 aa, Bacillus licheniformis
MKKTLHAPVKLIIAIFMICTFSIGFTEYVVMGILTSISKDLSVPISSTGLLVTAYAGSVCLTGPIVTIFSVKMPRKPVLIGLMSVFVLSNALSFLAPNFTILLVSRILSASIHGAFFATTMVFVSEMAPPEKRAAAAASMNGGLTIALMLGVPFGSYLGDLFNWRIVFLMIACLGLIGLAGIWLTVPHRKPKVVPKLIHEWDVFKNKQVLFSFAITIFGYSGVFIAYTFIEPMLRHSAGFDSLGITAALFAYGFGGVVGNFYAGKVPFHLLTRSMIGVMIALMAILAAFPFVSGHPAGAIIVTFLFGAGAFAFGTVPLLQTKVVAASEHGTTIATSVSIAAFNLANALGAWIGGLILNASESTHTLPQAVRL

SEQ ID NO: 7602 - protein, 421 aa, Bacillus licheniformis
MLTNKQKQGRRFEMRPMKSNASFIMYFVCISAFFASLNQNIYSPIIPLIRDSFHVSVSMVNLSVSLFIFITAAMQIIVGSIVDFKGARFVMMASMIVTVIATIGCAASRDFGLFLFFRVLQALGTAALPLIAATTIGSLFKGTKRGSAMGTYQMLLSLAPAAAPILGGFIGERYNYPGIFWFLTVLSVLLLFGNLFCFPRSHSEKKTNLSAGSLLSHYKDIFKNRAGNAVLILSYLIFFIYFSMIVYLPILLTDHYHLDLQIVGLLYLPIAVSTIAGSVLFKWIQKRLSLRRLFLIGNLTAAGSVVCFAFSHLFSLFAMSAALVLFGVTMGLIPPLFSTMMANEFEENRGSAMGMFNFIRYTGMACGPVISGMLLGMSSSVFVFGCFGIVYAAAALLMTAVMRKAAHTKTLQEPNKKAARS

SEQ ID NO: 7603 - protein, 249 aa, Bacillus licheniformis
MTELIMESKHQLFKTETLTQNCNEILKRRRHVLVGISPFNSRFSEDYIHRLIAWAVREFQSVSVLLAGKEAANLLEALGTPHGKAERKVRKEVSRNRRFAEKALEAHGGNPEDIHTFSDFANQTAYRNLRMEVEAAFFDQTHFRNACLEMSHAAILGRARGTRMDVVEVSADMLELAVEYVIAELPFFIAAPDILGVEETLLAYHRPWKLGEQISRNEFAVKMRPNQGYLMVSEADERVESKSMQEERV

SEQ ID NO: 7604 - protein, 406 aa, Bacillus licheniformis
MNQSLKTFSVLSEQYHENPYQYFSYLRESDPVHYEESLDSYFISRYQDVRRVLQNQDVFTTKSLAKRAEPVMRGPVLAQMKGKEHTAKRRIVLRRFIGESLDHLTPLIKENAQRLLAPHVEKGRIDLVNDFGKTFAVCVTMDILGLDKNDHQTVRNWHSGVADFITSLNQAPEDREHSLKCSEQLAEYLNPIIEERRKNPGHDLISILCTSEYEGVAMSDRDIRALILNILLAATEPADKTLALMIYHLLHHPDQMNDVLEDRTLLPQAIAETLRYKPPVQLIPRQLSQDAEIGGVELKEGTTVFCMIGAANRDPEAFEDPDKFNIHRSDLEVKSAFSGAARHLAFGSGVHNCVGAGFAKTEIELVANIVLDQLKNIRLEEDFIYRETGLYTRGPVSLNIRFDAKH

SEQ ID NO: 7605 - protein, 151 aa, Bacillus licheniformis
MNKSEAQQFLSNMYQDIVSEMNTEKIADYFSEDYVQVTDGSHIDLVQFKDHIRTLKNVARTITVSPFHEFLFDERLESAAVRYTVKVVKKNGDRGRIDIIAIFKMNGFKIVQCHELSHASEGTKGIEELAKISEAAIEKASSREEKAFSQD

SEQ ID NO: 7606 - protein, 157 aa, Bacillus licheniformis
MENKTYEQAFQAVQDFILKREKRAQHEQQAFAEEAFQEEESMRKHWTLTQLHIISLISESEADVNNAFLAAKLQISKAAVTKAVNVLTKHGMIESHKKPNNNKELYYTLTDEGKKLADIHDRMHEIAKQRYIELFDRFSESELQTVIRFLNEWSKHI

SEQ ID NO: 7607 - protein, 198 aa, Bacillus licheniformis
MFNRVYFEKEAWSLLEESDRTQVYAYALGLIDGEFDWCVAADGGLAEWAETFRVLQGLEIWEEHGARIERTNPVFGPGIAERFEWASSLVISDHVQAFMKREAVRKRLSEWLGEDGLLVIPTAPGPPPLRGLPENELNERRARTMKLTCIAGLGGLPQITVPLPAKNGEPLGLSFIAGCKQDLKLLAWTEKHVLSPQV

SEQ ID NO: 7608 - protein, 221 aa, Bacillus licheniformis
MEHDWSAFINRDLMVDPPSAEGSLKKLSFAVKDVFAVEGHANAAGNPDWLRTHEPAEKNAEAVDLLLREGARLKGAAHTDELMYSLDGENVHYGTPVNPCAMDKIPGGSSSGSAVAAASGMTDFALGTDTGGSVRIPSSYCGIFGFRPTHGEVSVDGVIPLAKSFDTVGWMSKDIGVLHAAGRVLLSGQEEAGACSTGFILKKRRGACLKKATGHKYTLMH

SEQ ID NO: 7609 - protein, 349 aa, Bacillus licheniformis
MVDKVRTGILGYGLSGSVFHAPLLSVLEDYEIRKVMTSRKEQVKQDLPEAEAVSTIEDITKDPDIDLVIVTTPSGLHYEMAKECIRAGKHVVLEKPMTATAEEAEELINAAKEKGVLLSVYHNRRWDNDFLTIKQLIKEGRLGEVNTFHASYDRFRPNVRQRWREQKGPGSGALYDLGSHLIDQALHLFGMPNGVTAQVTAQRANAETDDYFHVILHYDQRQVILHSGSIVPANGPRYQIHGSKGSFIKYGIDGQEDALRAGHKPAGDEWGADQPEYYGELATVEGDEIRKETVETLPGSYLTYYKQLASSILEGGSLPVTAEEGRDVIRIIEAAQKSSETNQTVFLNK

SEQ ID NO: 7610 - protein, 211 aa, Bacillus licheniformis
MTKTLYITAHPHDERASYSMAAGKAFIESYKEAHPDDEVIHLDLYRENIPQIDADVFSGWGKLQSGSGFEQLSEHEKAKVGRLNELSEQFIAGDKYVFVTPLWNFSFPPVMKAYFDAVAVAGKTFKYTEQGPIGLLTDKKALHIQARGGYYSEGQAAELEMGHRYISIMMQFFGVPEFEGLFIEGHNAEPDKAEEIKQNAIVRAKELGRTF

SEQ ID NO: 7611 - protein, 322 aa, Bacillus licheniformis
MKNQYRVLLYYKYVHIDNPEQFAEDHLKFCKDLGLKGRILVAGEGINGTVSGTVEQTDRYMSEMKSDPRFEDMVFKIDESEGHAFKKMHVRHRDELVTLRLEDDIDPNELTGKYLEPKEFYEAMQQEDTIVVDARNDYEYDLGHFRGAIRPDIKAFRELPEWIRDNKEKLEGKKILTYCTGGIRCEKFSGWLKKEGFEDVSQLHGGIVTYGKDPEVQGELWDGKCYVFDERISVPVNQKEHVIVGKDYFTGEPCERYVNCANPECNKQIICSEENEHRYLRGCTHECRVHPRNLYVKEHGLSEEEVQERLEKLKEEEHAAQS

SEQ ID NO: 7612 - protein, 63 aa, Bacillus licheniformis
MSLHDEKEIEKLLENFTPMIKSKLEREDLEQELKMKICEKAEMLLCQEVPGFWEFITELLKVL

SEQ ID NO: 7613 - protein, 193 aa, Bacillus licheniformis
MIDQTLLRAKIKEITRHPLVKHFLSNPRYERLFNHVLEHPDSEEAECLDREFKRFYKKIRMIKYINSMIRIFSVDFDKRVRKNRERFPLMIDDSPNLPEPPRGDLLDDVLEQEEELSEHLQDPMLYEAFLQLTDKQKKVLAQIYIHGVSMQEIADSLGESRQNISKIHKRALEKIRELLNSKAEGNDNSESAR

SEQ ID NO: 7614 - protein, 49 aa, Bacillus licheniformis
MDSAFIEEAAKQIGNVGFPAVLAIYLLTRFEKKIDELIELIKEKNETDD

SEQ ID NO: 7615 - protein, 384 aa, Bacillus licheniformis
MEKNKQIPQPIRGEKGAETKIPHNVERDRQNPDMLVPPETDHGTVPNMKFSFSDVHNRLEKGGYAREVTVRELPISDKLASVNMRLKPGAIRELHWHKEAEWAYMLYGKARITSVDQDGRNFIEDVKEGDLWYFPSGLPHSIQALEDGCEFLLVFDDGSFSENSTFQVTDWLAHTPDEVIAANFGISKDVVASLPVEEKYIFQEAIPGCLEKDKVESPNGTVPLSFSYNLLEQEPIISIGGKVWIADSTNFKASKTIASALVEVEPGGIRELHWHPNTDEWQYYISGQAKMTVFAADGHARTFNYQAGDVGYVPFAMGHYVQNTGDEPLRFLEIFKDDHYADVSLNQWLALVPEELVRQHLDVGSEFTKMLSKEKHPVVKFDKK

SEQ ID NO: 7616 - protein, 132 aa, Bacillus licheniformis
MKHFIICCISVIFVFFAHFLGISILFHLSGAFYQTVGSLLLFTLCYTGLTFVLEPAEKVLIHSMKLLGINRRITVFAAEMITIGCLWAAIYTADELLDDVLLTTSAEIMIAVSFFTIDKILYPRQRSGSLLY

SEQ ID NO: 7617 - protein, 161 aa, Bacillus licheniformis
MNKVLFRPGMSIKEIGEQLQGYIAANWKQTLDDHREALLKVFPELEDATYGVYLDHLLPPVFESLEQSGFTTIQNAGKGDFFIGKGLNFRQSMEKWGADNCRSRVFWVVISDQQKQPAGTLLFDFYHSHAGFDVPLSPRIYTLEETERDRIVAHIKQIKEN

SEQ ID NO: 7618 - protein, 180 aa, Bacillus licheniformis
MYKTNILHKGETHENFRSVDTPVFCHAVSAKNAGKACGGSRICEYWRVGGLAALFKTFEAARHDGRHRRRTKRGYREPVRFGFFNKHLKETGGNLVPANKTGMYQGRQVTVTEHVLGGYRKGGKSNSPYTSFTINQKVAKGYGKNTIELDISALRKAIRSGEVKDIVILSPKQIERFNQK

SEQ ID NO: 7619 - protein, 94 aa, Bacillus licheniformis
MLLYYKNECLGEIKGATVEGVWMYGTIIPNENMEKFKDFFKAVVNEDDPFAIEQYSEEWLDDENWFIIDEKQKKVGISLPGIYENDNEINWRWR

SEQ ID NO: 7620 - protein, 4 aa, Bacillus licheniformis
LAAE

SEQ ID NO: 7621 - protein, 65 aa, Bacillus licheniformis
MRSSTFNKKKKGRGKMSINKIRSALYKSAKILGDVNAAKNGTLGKRMARRAAGKTAGKILGKLFK

SEQ ID NO: 7622 - protein, 119 aa, Bacillus licheniformis
MKRTAEFTLSLIATIFLTIGWFFTAIFTFFYGFTPADEADMGFFYYLLIYTYLSIPLLVLIWVATFKVKANSKGWGIFILIMGVLYTFSIYFVSGILLLIAGIMMVAKQNNNSSNVMSA

SEQ ID NO: 7623 - protein, 286 aa, Bacillus licheniformis; identical to SEQ ID NO: 4681

SEQ ID NO: 7624 - protein, 110 aa, Bacillus licheniformis; identical to SEQ ID NO: 4682

SEQ ID NO: 7625 - protein, 72 aa, Bacillus licheniformis
MKKSEQILEAIDELTKEKGFPPSVREIGERVGLKSSSTTKGHLDRLRKKGLVDWEEGKPRTLHILYKEKATI

SEQ ID NO: 7626 - protein, 189 aa, Bacillus licheniformis
METIAKRVCKPFILLLTAVLLVTFVVPQISQASEFSNSQVKSYSDSGDYSEKELEEILKFYFEEVGELTNEGYVIKNKELFDKKVLEGDPAALKLKELMASDSSFQKSSFQVASATSFGKCVVNKMIGSYGNIARQFLNGAIFTYIKTKQYDLAARLMFKTLIKSGMKVNAASLAIELGYYGWKCRGKW

SEQ ID NO: 7627 - protein, 76 aa, Bacillus licheniformis
MKENEKIKFIQDEVLTAAEAGELLGVTRQRLSALVTSGKLKPVKKVGTVSLFLRDHVETQKKELEAGRKKYRPYDE

SEQ ID NO: 7628 - protein, 69 aa, Bacillus licheniformis
MKQYFKHYSSLDMATMLILIAGIFAIDFEKVGTLGKITGIILYLAVIVTLLKGLIMIWSEKRHEGKRKN

SEQ ID NO: 7629 - protein, 340 aa, Bacillus licheniformis
MDEKQIHMPDLTARNAIDFCNNSFDFDGIKKVIFDFKYSNTVEPFGMLMVASKLRRLVERYPGIIWCDNHHDKEYAGHMGFFQSWRIDYGKKPGEAWGSNTYIPITELKVRDLRIESYNRNEVVQTTIERKSYELAKVLSQGNNNLKDVLGYSIRELMRNIVEHSTSESFWFAGQYWPSKDKVEIALLDEGVGIAQALGVNPNLNIKNDKDALYLSIEPGISGKAFEYNGVMRGQSNSDWDNSGYGLFVTSKICQHGGDFLICSGKNALSIKGKGHYLYDTDLTGTAIKMTLNTSNLNKFNTFLIDSIVREGEERAKVNSHNSNLTASKVSRMLTTTEDN

SEQ ID NO: 7630 - protein, 509 aa, Bacillus licheniformis
MKTLDVQALHNAIDQTLEQLKQQSDEFSKVKKAVEGITSLDDALKGKGGDAIRAFYEECHTPFLQFYDTFIEEYSSTLKKMKSALNSLEPNHNGFISQSFLEHELENGLNAADRTTKHLVSKANATIAKVSHIVDLPDLNDSGFHEQNQKALKEISTTLEKLHAFDREQTNALKTAENDLETMQRYMARLEKMYTGPKIEITGYQKGAILKPDEMDTLSGNQETAMGAMLKKVGDKEDVDTNTIADPDRLKKLATQKVSKKEYTQEELNELKKDYRVFNDTLYRAYIDGDTIVKIEPAYTLPENVEKSDFNKNFDTAMEFTGVYDAVRAAFGYDLATGEIVKGNGDRLMAGLSVTPFGKAFKYGKRGFKLFKGEEAGKKLAKVDKTPSYGKQSVPKGPYREVHGFPAKVKPGAQEKHIPGTPNYKQEIANGRKNKSIFYGDNKTAQELLDKFAGKGTLLKNGVKERVDFGKVIGKFYDKDTGKYVETTRGLIHYSKNGAHIVPSEPLKP

SEQ ID NO: 7631 - protein, 112 aa, Bacillus licheniformis
MGYDPLISALRKYKNNDLIIEWKSGLKVIGEPDTLYETDNGLDDDDVNYIEYDAVAFQVNNILSQPTNKDCGVYDWLRQGESSLIEISLYEDTPSAVYLTDGQKIWEMDSDE

SEQ ID NO: 7632 - protein, 359 aa, Bacillus licheniformis
MVKVVKNYVKVNQYTRPGLKLAGVKGIVMHWTATPGASALNERNYFNGTCIADKRYASAHYFVDRKEAQHIIPENEVAYHAHDQNRCYVSFLKPNANTTAIGVEMCVEKDGKIHSQTIQNAAELVADLCKRYGLSTNKIVRHYDVTNKSCPTPWVRDASQLTTFRKKVDALLGNNTVSKTTSSTSQSSKSTGTILKKGASGSQVKALQKRLIAAGFSLPKYGADGSYGNETVQAVKALQKKAGIAVDGIYGPATEKALAAIEAKKKKSSSSGKKSSYTLPSGIYKVKSPMMKGTAVWQIQEALAALYFYPDKEAKNNGIDGYYGPKTANAVKRFQLMHGLSADGIYGPKTKAKIEALLK

SEQ ID NO: 7633 - protein, 87 aa, Bacillus licheniformis
MTTFDKGTVVRTVLLFIALVNQTLIVFGKPVLPISEDQINTLADALYLAGSAAFTIITSVVAWFKNNYVTGKGKQQKEVLKQKGLTK

SEQ ID NO: 7634 - protein, 97 aa, Bacillus licheniformis
MRTGGFQDMHQTNEWDVFKQEITELKADHKTLEQRVITLERASDRHDQQIMSINDKLNKIEENTTWIKRSITGAIITAVCTLVISGIAALFINFIQK

SEQ ID NO: 7635 - protein, 60 aa, Bacillus licheniformis
MKYPTLADIKQFYDWGCYTDEEMREYVKIKWITPAEYEDITGRSYDKPDTSVDLGMPSAQ

SEQ ID NO: 7636 - protein, 104 aa, Bacillus licheniformis
MKWLYKYDEKFNYMPGEEIQVEDDAELPEFYCEVKPPDGLYLAKFDPAKGEWFESATKEYIESLQPPEPEPGITDLLKKQNALLSLQVARLQADVEALKGGGAS

SEQ ID NO: 7637 - protein, 447 aa, Bacillus licheniformis
MIYKNTAVHFDVNAQVKRSVSANIQFSTQDIGTAKLSFNLTKDGVPLPISKATHAKLFMKFTDGSQVYVNTEVEDALKGAIFYVLTPEQIKHAGTVHAELYVKYDNGQKMSVHKFSFEIDKALIDADIVPVAEYYFEDFETFKAEAEEMIDDLQAKFEMLDNIETKEGAQARADAAETNAKAYMDKHASKKDNPHGVTKDQIGLSKVDNVKQATKAEFDEHHSDNTRHINKAERTKWNAGQLYKLTDDNGGRTLIPDDTDLLTLPSGLYYGVSNKVVNSPEPKAVEWFHYDVSTNNARKTIVVTATANPKRWFGTIHTDGSFKGWQRFITDADAEVTWQSPTLLNGWKQYGTHKVQFSKNALGEVEIIGSITGGTIGFDVPAFMLPAGYRPIQMLHFIGVASSQGTGTTPQYHRTQIATDGTVYIQSCSNTVNPNEFITFGFKFKAA

SEQ ID NO: 7638 - protein, 651 aa, Bacillus licheniformis
MQRLIKDYDQTRNSRYQAQLRADMQSIENSLNEQERQIQSHQTSKKAHTSDQIAHSSGLTVSQEIETAKARARNLVLNADGTNIKEVVDARVDRRGTIYPTLWDRLAADGQYIETRFNFKNALNYGADPTGKSPSAWAIQKALDEIRREGGGQLVIPGGIYLIEKRMIVYENTRVTMAADCVLLRGWAGGFFVNGRPDDSFSGFSGRSNIIIEGGILDGNYANIDKYPSTAMDSIILGHANNIWIDRVTFKDTITAHAIDANGINNLQITRSNFFGFIDLSGKRPFSEAIQLGEFVEMGVNQFGEFDGTPNQNVYIAHNHFGKSELLGGWGSAIGNHYAVYDIFQKNITIFDNTIEDCGFAGVRTFKWGEVKILNNRFKRNNECIRISQAAGGIESSKNVEGVQMNRPQNAQNVLIQGNDFYDYKSYGILSFGQIYNNEVAWSDGIRIFGNYFKLKAKEIGEYDDEQAIKLVFARNAFISDNRIFGGRRGMWIEGCYNTFIDRNYVSCVDTEAIYVEKSRDKTSTVPKSYHLSIDRNEINTTGRNGIFIQNCDHFDVRDNNVMNTNKEQSSTRGRGGIYVENGYDGRIENSRIRGVEKAFAILVKDAATEVNVTNTKGTGRVIVQGDSNFNGYYGTTKDDYIRKIITKSSS

SEQ ID NO: 7639 - protein, 263 aa, Bacillus licheniformis
MRDALDFALKNTDFKYIFKTPESEFESADQENFGDKNSTELMDEIIEDYGIEIDVDNYKIYIYKKMGKRINFTLDSRYNMPGISITTNSQNSTTRAWGYGALKKGSSTDDKNPQYEFEPILYIHPDEKKFLIEGKPRWAEPIRDERYKKASSMISALKRHVNPYPEMTVEADFQKIYEPKLLEIEQDFWKGDTIHVLADTADGITFEDNVRLVSIQYNPLNPYSSPKLTFANFRKDIQSINVDQAKRLRDQKRYIDQLFKTLR

SEQ ID NO: 7640 - protein, 305 aa, Bacillus licheniformis
MANTDFIKEIAPDAQRVYKKYDILASLIIAQACLESAWGTSGLVQKGKNLFGIKGTYNGQYVLMWTTEYDKSGNATKVQARFRKYPSWYESIQDLAKLYVNGTSWDPNHYKAVVGEKDYKKASAALVKAGYATDPNYATKLNNLIQTYKLTQYDTVGGVPEGPDEPETPIPDPEIPSKEYDGKDITLNQNLPSDTDFPQLHVSTKDGKKVVEITGVSVDLTDDTTGKKSFTFTITKTQENGTEFDLLVDDNILYLDEKKFKPQKYSLRVSNFIKRKMLLVKPLQQATYSLCCLLTTGFMKLYQRN

SEQ ID NO: 7641 - protein, 278 aa, Bacillus licheniformis
MKLFLDYDNGLGEQSLNSLLPFFEPLSFTPEAPGIDRETVSIPRINGVVLPQHPRDVTYTERKITVEFYLNSIIAENFYQFRRELYALLVKPFPYYISTDLLPNLRFRVTCDGNFSIPKEKEKNFVTFTVEFNNITGLAESKFTSLTKQNFDVEHWSPGMNIQMRDDLEYRFKNRKRFQVYNTGDAYINPLEHDYNVALWAAGKNVTIINHTNGEKLKIEQELKKTQRVSFIKQYTVINKTPIKTSGRLPGLDIGMNKFEILNTNDFEIIFDTRFYYA

SEQ ID NO: 7642 - protein, 1245 aa, Bacillus licheniformis
MPGLLATAAAGQTDLGVTADIVSDILTEFHIKAEDTNRVADAMTYTFTNSNATLQEIGQTMKYAAPAAKTAGLSMEELAAATGIMANSGIKADMAGTALRATLTRLSSPPKQAGNAIDELGLKVTDSTGKLRPLADIIGQINEKTKDYTETEKIRIAKQLAGQHALSGFITLMHAGKDKIQEFTKEIEGSGGTAERVAKKQMDNLAGSIEYLKSATNNAVITFGNQFLPVIRATADGLTKLVTWFDSLPPSVASTIAITGGAVTVFSLLGGAFLLLLGSLPKVAAGWNMLRTAGGYLTRNVNQASGSLGVYSTEAIAAGAASRTAAAGMTTTSAAAAAASTRMGRFHQSANLATTRVGRLEQSSSRSAKAMRGLGGASRVAGVGLGLFGGPVGSIAGLILSFAPELLKFGGNILKVGANAIKGAGGFMKLAKSGFGLFNILKKGAGVVGLLRGGLSLLGGPVGLAVTGVTLLTEAGTKYYDNLKKRVLPSTIDFGEGVSKATAKAVNAYEDMNIKVTAKLNTLRATNTKITKDIADDVTKQFTEMGNSLKKGFQTSADSATKVLQEFYASNDKTSDKEAAKILNKIKNGNDKKQKEIQGYVDRVNEIYRTAAEENRKTTAKENREIAEIQGKMLAQMETALTRSKDEQIKISRKLKEESSNLSAKQAAAVVKNSNKAKEKTIKAAEKQRDSVIAAADDQYYVKGTISKKEHDDTVGKAKSQAKKTIKQAEKTHKGVVKEAKLQAYGHIDQVDFETGEVLGKWDIFVLDLAGVVNKITGGINTVLEFMHIPTIPEWKPKGYNGRSEKMQIAPGAAYAKGTDFHPGGKALVGEKGWELAHTPGIGMYVVGMGGPQIWDLPRGTSVLPHDQSKELAASGLPGYAGGVGDFFKKAAEGSKKMVNGAISFGKGVVDKVGDVSSSAMDLIINGPGKLIKKLFSGLIPYKSGKGIDSFGTGILKTLKNGAAQFLKGVMPEPSTFKGTGGTKAVNQWVTEAVGIAGVPLSWIPGLVTIAMKESGGNPNAINLWDSNAKAGHPSQGLMQTIPSTFNANKFPGHNNILNPIDNTLAAINYIKRRYGDISNHPGLKSMARGGGYVGYAKGGISPGRGGSKWAILNERGYDETTITEDPSYRERNIGLWARIGSKLGVLPDLQDGMISKALLLLQKVSEKPKQQLPPNDFSVDISRVVKNQEKQISMMAKQIDFLNKNVQLLQRLLLKDNNTYLDGRKIDQSAGDRFTRTSFINGVR

SEQ ID NO: 7643 - protein, 235 aa, Bacillus licheniformis
MAQPIGNMIVKVGLDDTGFNRGIEGLKRQMRLANSEMKASGAVYKAAGNQSKFLQSQIEGLNNKYRIQGRLVDEHRAKYNKLVREKGLDNRETQIQGRRLNDAIAVHQSLGNELQRVTKQFENTTNSTRRAASVFSVFKRNSGEVSKELNAVYQAASTAGKALSALGAAGSFGIGMTVKAAADFEKAMSRVGALANATNDQMADLTKTARHLGATTQYTDGQVAEGMQYLAMAGY

SEQ ID NO: 7644 - protein, 32 aa, Bacillus licheniformis
MTEIDEMDIYHYLEVLAHENKPKVVPIDQIFF

SEQ ID NO: 7645 - protein, 120 aa, Bacillus licheniformis
MAQKHISIKLWFEEEGKYKTFIAPRTNTKTLFEALKLDETASKAKNLKEVLKSLEDRMKFIVRVFHNQFTLEDFQEGLQSFEVSDEVRRIMGEIMGYEEPDEEEDFLPAAETEDLQLKTE

SEQ ID NO: 7646 - protein, 205 aa, Bacillus licheniformis
MPEYSSVTGLEGVKFAPLKKENGFYVATKIIDYPYAINAKVNTETSTEKQYADNKLVDMAVTTGSTKLELEMRDLPMEILEELFGIEETDGIYMFKKNVIAPWVAMSFYGPKANGKNRHVGLVKGRFSLPDDEWKTKEEKTDFQTVKLSAEFMEREQDNAYKVLADEDAPNFNLDKFYEKVFGNAYKNPDSGSDNKSSVDIGKTV

SEQ ID NO: 7647 - protein, 127 aa, Bacillus licheniformis
MNVAERALQLKNKVFEALETDPALLLLADPANIFELAVPIGIKSKPAYIVVQELDYRTTKWADGKPIKDSAVYQIDVYNDSSCDQILAAVIGVMNRMDFQTGILINDFLKDEGLIRKGRRFEANILI

SEQ ID NO: 7648 - protein, 132 aa, Bacillus licheniformis
MKFEIEMQGFKELDSYLSSLARKDEKINKATVKAGGAVLAKEIKKNAPRSNIGGSHPHIDEDIIVGNRTRKDPDGEIYAVVGPTKDTKFRVHLPEFGTIHQPANPSIQRSMLSANERMLQAMASVIKRGYKL

SEQ ID NO: 7649 - protein, 102 aa, Bacillus licheniformis
MLNDMRYRIKFQKKKEGGRLPVEGDYETVVECWAKAEGLKGREYYAAAAVKKEETVKFTIRHREGIGKHMRILFQNQSYEIESIIPNYSRKNFTTIRAKAVE

SEQ ID NO: 7650 - protein, 100 aa, Bacillus licheniformis
MTETQQKELEEAKKFLRVDGDLEDDLILGFIASAKEYITSATGLKFPNNSARADLCVKAFVTHWYENREIAGTTSNLDGVLTTLINQLKYTVSETDADAE

SEQ ID NO: 7651 - protein, 141 aa, Bacillus licheniformis
MADQFLNQSNGVFTSAEDDGTGKPVTPVYLKDNSEENPLYIKGMQGEPGPQGPQGPKGDKGDTGPQGPQGEPGPQGPKGDKGDPAVIEEKSITHEMLGEKVVRSNNVGTGSIMMDNLNSEVKAIFEDLQKQIDELKGGTSS

SEQ ID NO: 7652 - protein, 427 aa, Bacillus licheniformis
MKQKKLLRLDIQFFAGGGMSKKERELRQTLAEKRTRIEALTDEGKMDEAKKLLAEAQQIKDQIQTYEDLRNMQVSYAQEEPQQDPEAKNPQQPTDDIAKTDAKNHAQLFASALRTGKVPQPLAAMKEGVDEDGGLIVPQDISTKINEKRRQFDTLANLVDVIPVSTNKGSRVLEKLADITPLVNLEELADIEELENPKFENIKYSIKDYAGILVLSNDLLADTQEALLQYLSNWLAKKSAVTRNTLILNQLGTLAKTTVSKQDDIKDILNVKLDPAINATTKVVTNQSGFNVLDKLKDAFGRYLLQPNPTDPTKKLLFGKPVSVISDKYLPNGGTKTTPKYPLIIGDLKEAVKLFDRQQYSILTTNVGGKAFYRNSTDMRIIEREDVVLWDTDAVVYAEFASIKDAVPDNETPSTGDTEDKSVDVGK

SEQ ID NO: 7653 - protein, 243 aa, Bacillus licheniformis
MATEQKKKNKYWNMKVLNDSTAEITLYGSITGEGWFSESSSKAFQAELKSLGDVSSIDLYINSPGGDVFEGQAIHSMLQRHKAKINVYVDALAGSIASVIAMAGDKITMPSNAMMMIHNPYMGMVGNAAEFRKAADDLDKITESIVSTYLAKAGDKLDDGTLRQLLDEETWLTADEALNYGLIDEVSESKDVAACIDHQVLAHFKHVPGKIVAQSTAESPAEETKPDELLKQKINMKLELLNL

SEQ ID NO: 7654 - protein, 436 aa, Bacillus licheniformis
MLLSRLKSGIKNEIAEEDSGSLLHPVDWFKNIFAGSESASGERVSTKTAVLHPDVYACVIVLADDIAKLPIKLFQNQNGNIQQVQNKVSDIILNKVNDYMTSFVWKRLLVTRLCTWGNSYNLLLFDKDGNVTGIRPLDPEATNTNIDPDNGRVWYSTTIDGRYREFFYEEVLHFKNLSLDGIVGQTPISVIRDNIGSNRAATKFNAKFYKNGGAPFGVVKAPTLLDRKSKQILREDWERVNAGQSIAVLDAGLDYSQVTMPMKDAQFIESMKWNRQQIASIYKVPPHKIGELDRATFSNIEQQSLDYVKTTLQPIVTNIEQELNDKVLTEKQQGAGYYFKFNLESELRGDSKSRAEFYKTMQSVGAFSVNTILQKEDMTGIGEIGDEHYGNLNLVPLSIMKEYQLSKVKRSSNRLKGGDGNGTEEEKQVLEHEGSE

SEQ ID NO: 7655 - protein, 63 aa, Bacillus licheniformis
MKILKTLQLFLEDILLIAGMVFISIAIYRINVNAGLIATGVFLFSLASLAGFVRQKNKDEGGK

SEQ ID NO: 7656 - protein, 569 aa, Bacillus licheniformis
MNTIKQFMIDYSRDVISGEIVACEKHIWACQRFLNDIKREGTREFPYVFDDEKARRFLYWMTQFKHTKGPLAGENIVPDRIQIFIFGNVYGWIHKDTGYRRFTKVYWQVGRKNAKTQSLACVASYEAMANNEKMSEVYIGATKTEQAQICWKEIKAQIEGCELLNKPEQKYRIAYSTIEHPKTNSTIKALSKDAGKTGDGFNPQCGIIDEYHAHKTSEIYDILESGMGARTQPIMVIITTAGHELNNPAYRVEYDYVSRLLDPNKVETNEQYFVMVNEIDKDDDIKDERNWIKANPILASHEVGKKYLRDRLEMALAVPEKMRDFLTKNMNVWVNMRDGGYMDMQAWKDCGSDQFPDLSGRECYVGIDLSKRIDLTAVSFIFPLDNGSFAVDSHGFMPEDTFYERMKTDNVPYDLWKEKNWLTVTDGAVVDYDYIRAYIKKMEKEKGWRIKEIAYDPYNATQFAQQMEADGYVMIEIRQGVATLSEPTKDFREKVKAKKIIHNKNDLLTWAMGNAVTKVDAQENIMLDKSKSTQRIDPAAALINAHVRASQIDTAIDLNAYIQSGSFSL

SEQ ID NO: 7657 - protein, 171 aa, Bacillus licheniformis
MPRPAKSAALQLIQGNPNKKNTKELAARAKHEKKLKMRSENIKPPTWLDKVAKKEFKRIAALLSEVEIMTEADISMLAAYCNAYSQYISITKIIEEDGIMIHTEGQGENGKPVKLIGEEHPLLKRQKNFYDQMKSAANDFGLTPSARAKLAITKTQEEREKTLAEKEFSNV

SEQ ID NO: 7658 - protein, 124 aa, Bacillus licheniformis
MPPKPLRECKAYGCKALTREGYCPDHKHVQQEETKHYNKHSRNKTLTSFYKSTDWKRTRELVLLRDNRLCQRCLREHRFTPADMVHHIVEVKQDWSKRLDFSNLESLCNACHNKVHGDRSKSVK

SEQ ID NO: 7659 - protein, 74 aa, Bacillus licheniformis
MFHCKPNVMPPIVHPTNCCQTHTFSKTIVPHIHPQHITNVHHKHFQHVHQYPHTYSSYDPVTHSHTHCGKPCCN

SEQ ID NO: 7660 - protein, 126 aa, Bacillus licheniformis
MSKEQLSFLDDVDEKAVRKIVIKELKNYRALKVQLENKKECSSAGFNIFPSLRDSFTVNELKVKQMERALQNSLDDEERLIIEKKYLTAARVKDINIYMELGMKKDTYYEIKQRAICRIATALGII

SEQ ID NO: 7661 - protein, 41 aa, Bacillus licheniformis
MWRKTRGAIMIYVIIGILILAASFIWMEIAERRIQEWEKEK

SEQ ID NO: 7662 - protein, 90 aa, Bacillus licheniformis
MKKAIATIVILLLVALAAGCESWDRMVKDFNASNNGLERTATVYDQNGNKIKTYKGKFDVEVNDYGNKVKFDLDGKRIMISNAVVIVEEN

SEQ ID NO: 7663 - protein, 40 aa, Bacillus licheniformis
MAFVGFEESQEVRQLAESLIDKHHPHLKDEETHWFLHPGR

SEQ ID NO: 7664 - protein, 179 aa, Bacillus licheniformis
MTIIHYNYSDTELKNILDSMIIIVDTREQKNQHVLDYLRKKNVSIKFKGMKTGDYSAMIPKNEEYGISRDMYLNAAIERKNGVDELVQSIKDRSRFENELIRAAKHPFTLLVEDLEGYQKILNGKYRSQYKPQSLLGSLKTFEVRYNFSTVFINPSATGNYIYHHFHYMARELLKGGLV

SEQ ID NO: 7665 - protein, 151 aa, Bacillus licheniformis
MSKVREMHPKQICEDLAFLGSPLVLDGDDLYIEHPENVYPELVEFVQSHKKRIIQYLKGEYSVQDHKVKQTIDKIINYFMGIDQEMNPKIDDWFNHEWDAAIKAARLLVLFWENGWRDLNSSVANFEDEETDKLSLEIYERAMSYFKGKKA

SEQ ID NO: 7666 - protein, 123 aa, Bacillus licheniformis
MNSIMKIDEMTLTEKNKLYINQKREIDRLNKVIEDLEKQLSVRNENDEQSLISTFLKKYSSKISKQQIEAKQLYQEYEKWVKSLLLGKRNFYNVVATYGYEFKRGKGNKLFVKGEGNAPKTNL

SEQ ID NO: 7667 - protein, 805 aa, Bacillus licheniformis
MYEFKNIPQELKNAPQWILWRSEERDGKKTKVPYQIDGSMAQSSNKRTWSTFPTVLKFYNDRDYDGIGFMFSKDDPFIGIDIDHCVEDGVLSPFAEEIVQAISSYTEYSPSGKGVHIITKGKIPLRGPGTGRKNPELGLEVYRHGRYFTFTGNSLGIGAVEERTDELKELFEKYLKDKKEESKPSKLPAASSRDMSNLSNKEIWERMFNSKNGKSIQDLFNGHLINDDHSATDMALCNHLAFWTDKDPAKMDSMFRESGLFREKWDRQHSSDGATYGEMTIAAAVYSTHTTISDLLEEQQEQPYEIYISHPENSQVEDTEEIIDTPPAFHLTELGNAERIVYYHGKNIRYCNELDWLIWNGKRWEEDSKRKIEAITAKTLRALYGEAKATEDKFRKKQLNDWAKKCERRNIRMNTILDVRPMVSVRKQELDSHKYLFNCDNGVIDLKTGELLPHDRDLLFTKISPISYQTDADCPNWKTFLESIFIDDQGTPNYEIIDFMQKAIGYSLTGDTTEQVMFFLFGNGRNGKSTFINTVQHLFGDYGRQTNSDTFIKKKNDSAINNDIARLDGARFVSAVESEEGQQLSESLVKQITGGEKMSARFLRQEYFEFTPEFKVFFTTNHKPIVKGSDEGIWRRIRLIPFTVTIPKEKVDKKLPQKLAAEMPGILRWAVEGCLKWQKEGLGEPEAIKKATDGYREDMDILGPFMEERCIQHPKAKVEAKELYKDYKDWCFENDEIELKNRAFYRQLEIRGFKKYRGNYNKNYFDGIGLIKENRDLHKQLNPLKQRQNPSELKSNVTSIQRKKL

SEQ ID NO: 7668 - protein, 145 aa, Bacillus licheniformis
MFTVDHSKGEAFEPIKPGEYEATVINFEAKTAASGNERLVVDYEIRSDVEQPCQGQKILYDNFTVTENAMWRFHQASKAAGFPNGMQFKDHIEWAKAFLNKPVRLLVGEREHNGKKYPEVKAFKPSEAPAPETEPINISDDDIPF

SEQ ID NO: 7669 - protein, 310 aa, Bacillus licheniformis
MFQVTNAQREKEKAIVGFIGPSGSGKTAGALLVAYGMMREAYPDASDKEVWSKIGVVDTEHRRAKLYANLQFDDVRIGSFKHIDFTPPYTTERYQMALEAIKEAGAEVVIIDSLSHNWAGEGGIVEKHGEMQGNSFQNWGKLAPETTKLIKTLTQNDVHILATLRTKTEYVVEPNSEGKMAPRKVGTKPVQKDEMEYEFMLNFNIGIDHLAETSKDNTRMFEGSSFKLNPEVGRKLYQWLELGIDVKAEEEAERIRLIDEIKTIVAGNETAAQMIEEFQIKANKKLDQWTIKLASAALDRLQALKTKEEK

SEQ ID NO: 7670 - protein, 185 aa, Bacillus licheniformis
MNPLQAFELNEISNNSLQQESRPQFEITDMNSLNWAFRKIAALKTQEKEIKALAATERQRIDEWETQELKPLADNLAFFEKLVSVYHSKQLVQDPKAKTLSTPYGKSKSRTIKEQPKPTDKDQLLKHVKEAGLTEFIKEDVKWGDLKKSLSIKEVDGKKVVVDENGQVVPGVEIEPASTSFKVEV

SEQ ID NO: 7671 - protein, 80 aa, Bacillus licheniformis
MDQKQIDSVLHLVEYALRNGGRIDIVYHCKNEKAALQNVKDAAENLNTEINQRSYDNSFWYETEINRKIQMTAFYPSAYE

SEQ ID NO: 7672 - protein, 36 aa, Bacillus licheniformis
MNIEHPMITEINRYGYPLEYLKDEVEKEDENGSKTD

SEQ ID NO: 7673 - protein, 88 aa, Bacillus licheniformis
MNLNRFLKADREKAERLFISTRDLISELPAAIEEHDFEGCVEIAATIILNCKDLKRMEHPEQVVRLHEIASKFANRGLNVSTVRRSFQ

SEQ ID NO: 7674 - protein, 126 aa, Bacillus licheniformis
MKLNYDCVRSILLELEENLTLNDGVTLYQLKDFETFKEYGYETSVYALTKLIEADFLNGSVSRADNKIDYIGVGSITWDGHQFLDNIRDNAVWSKTKDAVKSLSSVSLSILSNVGESITKKLIGLE

SEQ ID NO: 7675 - protein, 56 aa, Bacillus licheniformis
MTNKNIIVYSKKDGVNRLLSIDTNDLISLTKFIEDHYPKEKDFIYALVQGVEIKLF

SEQ ID NO: 7676 - protein, 184 aa, Bacillus licheniformis
MKTQLKVIEGTRKPDHYSIYHRMFQKAVIESARKIQRTNQIDTDDFKKIAFAGIKMINLEKARSRRFLEVKLRLIEFIQTVIGKLTPGELMQMFPIRKQYDGEKFGMKDYFSTMHAVKEKGIDNCIGTEEEVFDFLWDYQNPDITLFMVTLVSTVSDLGRASGQKSLFEEFADKNDIAIDVMTH

SEQ ID NO: 7677 - protein, 264 aa, Bacillus licheniformis
MNLSIIEKNNQRVLTTTQLAESYGTNNRRISENFKRNINRFKEGKHFYSLQGKEKRDFINHTQIEDGSKNAQTLYLWTEKGAWLHAKSLNTDQAWDAYEMLVDEYYNVKQTQIDTSQLSPELQMFKQIFDSVARTQLKQQEQDKRLDAVEKKQDNIKEVLSLNPTEWKKKVNKIINAIALSKGGFQAYADVRKESYQLLEDRARCRLSIRLTNKKSEMALNGVPKSKIDKVNKMDVIGDDARLTEIYLAIVKEMAIKYGVGEAS

SEQ ID NO: 7678 - protein, 212 aa, Bacillus licheniformis
MTVGERIRSRRKQLNMSVDQLAQKLKKNRATVYRYESNEIDNMPLTVLEPLAKALNVTPAYLMGWESTEPVQLSTKYPYYPIGISAGLPLCIDSIDENNVEYILIPDNLMGKWAGRKDIFMMRINGDSMNRIMPHDSLIAVRPVPLSNLRDGDIVVYSDGGDYAVKRFYRREDKVIFRPDSSDLNFTDYVTSADNIDLRIHGKVVLYIAELD

SEQ ID NO: 7679 - protein, 364 aa, Bacillus licheniformis
MPVYKDKERGTYYFIISYTNRNGEYKQIKRRGFKSSGEAKRAEAETLLRLETDDGENEDNPTFEFVAKEYLKWYKKRRKASSYLKTSSIINTHLIPRFGSKKINNIRSRDIMRFQNDLLDRYAVAHVKKIHQVLSAVFNFAIKQEYTKDNPARLAGNVDIEEDKHINYWTLDEFKAFIQHVDDQLYYALFMTLYYSGMRKGELLALTWGDIDFDSNTINIDKTVYNRIVTKPKTTSSIRKIMMPKHVMRLLAQLKAKTKTKMTYVVFGEFHDHISTTTLDRKYAEYVKAAKVKKIRLHDFRHSHASYLINRNTIPSVVAKRLGHKDVGTTLNIYSHLYPSTEKEAVLKMEDDFKTAEIIHLKEA

SEQ ID NO: 7680 - protein, 157 aa, Bacillus licheniformis
MPKGEGKVVSQNKKANHDYFIEETYETGIVLQGTEIKSIRAGRVNLKDAFAKIERGEVFLHNMHISPYEQGNRYNHDPLRTRKLLMHRKQINKLIGLTKEQGYSLVPLKIYLKNGFAKVLLGLGKGKKKFDKREDLKRKDAKREIERAFRDRQKGLI

SEQ ID NO: 7681 - protein, 767 aa, Bacillus licheniformis
MEKEEFMDKLLSFMKEEAYKPLTVQELEEMLEITDSDEYKELVKALVTLEEKGLVVRTRSNRYGLPEKMNLIKGKVSAHAKGFAFVLPEDSSLDDVFIPPSELNTAMNGDTVLVRLSTESGGTKKEGAIIRIIERNIQKIVGTYTETKNFGFVIPDDKKITNDIFIPKHAKNGAVEGHKVVVRLTSYPEGRMSAEGEVIEILGHKNDPGIDILSIIHKHGLPGDFPAEAMEQAGNTPDTIDEKDLEGRRDLRDQTIVTIDGADAKDLDDAVTVTKLKNGHYKLGVHIADVSHYVTEGSPIDQEAYERGTSVYLVDRVIPMIPHRLSNGICSLNPKVDRLTMSCEMLINPQGQVVEHEIFQSVIKTTERMTYSDVNKILVDDDEELKQKYEALVPMFKDMEDLAAILRGKRMERGAVDFDFKEAKVLVDEEGKAKDVVLRERSTAEKLIEEFMLVANETVAEHFHWMNVPFIYRIHEDPDQEKLQRFLEFVTTFGYVVKGTAGSIHPKALQSVLEEVRDRPEEAVISTVMLRSMKQAKYDPQSLGHFGLSTEFYTHFTSPIRRYPDLIVHRLIRTYLIQGKTDEATREKWAEKLPEIAEHTSNMERNAVDAERETDDLKKTEFMLDKIGEEFDGVISSVTNFGMFVELPNTIEGLVHVSFMTDDFYRYDEQHYAMIGERTGNVYRIGDEITVRVVDVNKDERNIDFEIVGMKGSRRRQKPEPKQKKASKREAPSADKGEWFTKPKKKKVKKKRGFQNAPKQKRKKKKK

SEQ ID NO: 7682 - protein, 248 aa, Bacillus licheniformis
MKIVKPQPFTFKGGKKAVLLLHGFTGNTADVRMLGRYLNEKGYTCHAPQYKGHGVPPEELLSTGPEDWWKDVMDGYEYLKSEGYEQIAACGLSLGGVFSLKLGYTVPIKGIVPMCAPMYIKSEETMYEGVLDYARNYKKFEGKTAEQINAEMEEFKKTPMNTLKALQDLIADVREHVDMIYSPTFVVQARHDHMINTDSANIIYNEVETDDKQLKWYEESGHAITLDKERETLHKDVYQFLETLDWQT

SEQ ID NO: 7683 - protein, 76 aa, Bacillus licheniformis
MAAFLTVLLVIVSIVLIVVVLLQSGKSAGLSGAISGGAEQLFGKQKARGLDLILHRMTVVLTVLFFFLTIALAYFV

SEQ ID NO: 7684 - protein, 94 aa, Bacillus licheniformis
MKNTGIVRRIDELGRVVLPVEMRRVLNINEKDPLEIYTDGENIILTKYAANMACLMTGDITTKNKTYAGGKIVLSPRGAEMLLEDMMAALSEKK

SEQ ID NO: 7685 - protein, 105 aa, Bacillus licheniformis
MVKVLTKVNKSYMFNVDKKKHKRLERGVIMVKKIHIKRDFVLQYMIEHNLSLNQLAIEIGVSPATLSRVLNGERRPGQLVIGKMIQYFNKKFEDLFYYKDVDKSQ

SEQ ID NO: 7686 - protein, 135 aa, Bacillus licheniformis
MAMTNFGHHLRQLRERKKLTVNQLAMYSGVSSAGISRIENGKRGVPKPATIRKLADALKVPYEELMASAGYISASTVQEARSSYDSIYDIVSQYDLEDLSLFDSEKWKVLSKKDIENLDKYFDFLVQEASSRNKN

SEQ ID NO: 7687 - protein, 132 aa, Bacillus licheniformis
MTRFGERLKELREQRSLSVNQLAMYAGVSAAAISRIENGHRGVPKPATIRKLAEALKMPYEQLMDIAGYMRADEIREQPRGYVTMQEIAAKHGVEDLWLFKPEKWDCLSREDLLNLEQYFHFLVNEAKKRQS

SEQ ID NO: 7688 - protein, 225 aa, Bacillus licheniformis
MEVLQQLWTYYAQNGGYVLGEFYRHFLMSAYGVLFAAVVGIPAGIFIARYRKISKWVFSITNVIQTVPALAMLAVLMLVMGLGANTVILSLFLYSLLPIIRNTYTGIASIEHAYLESGKAMGMTKFQVLRMVELPLALSVIMAGLRTALVIAIGITAIGTFVGAGGLGDIIVRGSNATNGTAIILAGAIPTALMAIIADLFMGWLERALSPVKHHKGKTPNPDAA

SEQ ID NO: 7689 - protein, 305 aa, Bacillus licheniformis
MQTKKLRRLGAVMLVLSLLISGCALPGLGGASDKTIKIGAQNLTESEILANMISLLIEHDTDLNTVLVKNLGSNYVQHQAMLGGDIDISATRYSGTDLTSTLGREAEKDPKKALRIVQQDFQKKFNYKWFDSYGFDNTYAFTVTKELAEKGNYETISDLKKDADQLKLGVDNAWLKRKGDGYPGFKQEYGFSFGSTFPMQIGLVYDAVKNGKMDIVLAYSTDGRIKAYDLKLLKDDKRFFPPYDCSPVVPEKVLKEHPELEETINKLIGKIDTETMQELNYEVDGKLKEPSVVAAEFLKKHNYFE

SEQ ID NO: 7690 - protein, 217 aa, Bacillus licheniformis
MNQLVQFLQHNGGEMLYKTWEHLYISIFAVLLGIIFAVPLGVVLTRMKKGAGVVIGVVNIIQTLPSLAILAFFIPLLGVGKIPAIVALFFYSVLPILRNTYTGVKGVNQNLLESGKGIGMTAWEQIRLVELPLSVPVIMAGIRTSTVYLIGWATLSAFIGGGGLGDYIFIGLNLYQPEYIIAGAVPVTILAIVIDYILSKTEDKVTPQGLKGMKEVS

SEQ ID NO: 7691 - protein, 379 aa, Bacillus licheniformis
MLKLENVSKVYKGGKKAVKNINLDIAKGEFIVFIGPSGCGKTTTMKMINRLIEPTSGSIYIDGENIMDQDPVELRRKIGYVIQQIGLFPHMTIQQNITLVPRLLKWPEEKRKKRAEELLQLVDMGPEYLNRYPHELSGGQQQRIGVLRALAAEPPLILMDEPFGALDPITRDSLQEEFKKLQKSLDKTIVFVTHDMDEAIKLADRIVILRAGEIVQVGSPDDILRKPADEFVEEFIGKERLLQSRPDIEHVEQVMNPNPVTITSEKNLTEAIQVMRERRVDSLLVVDEHNVLKGYIDVEIIDQNRKKSVTVGEVVNENVYSVQKGTLIRDTVRKILKRGFKYVPVLDEEGRLVGIVTRANLVDIVYDSIWGDEETLVQR

SEQ ID NO: 7692 - protein, 179 aa, Bacillus licheniformis
MEENALKVIEQAEEHFIEKIAENMNTYGLSSTVGRVLGIIYMNRKPMTLNELSEETGMSKTRMSQVVREMIDLNIAEKVFEKGVRKDLYDVEQDYYQTFISLFTANWSKVAKKNRMIGKKIRKELLEALEEEGLTPETEAKINELLAETKQWIDYCEWLDNLIAFLESEEIFKHVPKPS

SEQ ID NO: 7693 - protein, 210 aa, Bacillus licheniformis
MFAFIIHVFVSLFAVTNPIGNVPIFLALTEGYEAKERTALARKAAVLSFLILIAFLIFGEFIFRLFDINIHALRIAGGIFIFGIAYNLLNAKQSHVQSLHHAEHRESKEKEDISVTPLSIPIISGPGTIATVMSLSAGSRSLVHFGGMIIGIAAVLLLTFAAFHYSTLISNKLGQTEMNVITRLMGLILAVVAVGMIGTGLKGMFPVLAG

SEQ ID NO: 7694 - protein, 237 aa, Bacillus licheniformis
MAGGSDGGKGAAETPQAARYAEAAKQASSMYFSYCLKVLKRPFIEMKNAGEQHVLNSITTMVIFALSVPLMFYFGLKGFFDAMGDYSGVFGRSYAMPTFFDIVVKPAVTFAIYIFLLFVFTYAGVRIRGVQAAFKEVLGRFGAVLIPFVALLLAALLLSFMQTGLFIYVLFFALCGIAFLIPPAVISSYHEKAEGAVDTIYATLIVYLLTFMSVRIMGDLFLEYIGRIGGSILGRLF

SEQ ID NO: 7695 - protein, 221 aa, Bacillus licheniformis
MDFCKECGRERTKNALYCKHCGARADEERASDPAARYQRAMTRKRIIIMAAIAACLILLFAGYKTGEALTSKEKLISDFEAALDQKDAKKAAKLLQSSDVDLAVTEKNVKPLLDYLKEHPDEEKELITSLKSGAGHPLMTIEKKGRRFWIYDRYVLNTEPVYLTVKTNYKDTGLFVNGKKVITTEKENFEKKIGPFVPGTYEVKAKLKSGIADLEGHRPPR

SEQ ID NO: 7696 - protein, 315 aa, Bacillus licheniformis
MKRFKWFALFAALILLLAACGNQDKDQSAEKNGSKDSYTVKHAMGTATIDGTPKKVVVLTNEATEAVLALGVKPVGAVQSWLGDPWYDHIKDKMKGVENVGTEAAPNIEKIASLKPDLIIGNKIRQEEVYDKLKAIAPTVFAETLSGEWKNNFKLTAEALNKKAEGEKVIADFDKRVEDIHEKLGDKVKQKVSLVRFTDADTRIYHKGSFAGTILDQLGFARPKGQEANDLGQMEVTKEQIPDMDGDVLFYYTYETGDDKASAIEKDYVNDPLFKNLNVSKKGNVHKVSDAIWNTAGGVLAANLMLDDIEKYFLK

SEQ ID NO: 7697 - protein, 130 aa, Bacillus licheniformis
MTKFLLSGFYLFGLVMLSNWSISFGEIFGAGNSAVFQLSEAVLFTFIIGCYTGLPLIYAKFTRSETLFFTNQKVFLITLGLGVLLSCSAYSLQQALSPIAIALLSIIGFLIVGISGFLPAWFLKPAKNLR

SEQ ID NO: 7698 - protein, 109 aa, Bacillus licheniformis
MQSKTVYLYAFHTMSDWEYGYLMAELNSGRYFKKDAAPLKVMTIGVNKEMVTTMGGLRIKPDISLDEWTPESADLIILPGGNTWGEKIHQPILKKAGEALELGAMVAAI

SEQ ID NO: 7699 - protein, 430 aa, Bacillus licheniformis
MPYIVDVYAREVLDSRGNPTVEVEVYTESGAFGRALVPSGASTGEYEAVELRDGDKDRYLGKGVLTAVNNVNEIIAPELIGFDVTEQVSIDKLLIELDGTENKGKLGANAILGVSMAVARAAADFLQIPLYQYLGGFNSKTLPVPMMNIVNGGEHADNNVDIQEFMIMPVGAENFREALRMGAQIFHSLKSVLKEKGLNTAVGDEGGFAPNLGSNEEALQTIVEAIEKAGFKPGEEVKLAMDAASSEFYNKEDGKYHLAGEGVVKTSAEMVDWYEELTSKYPIISIEDGLDENDWEGHKLLTERLGSKVQLVGDDLFVTNTKKLAEGIKNGVGNSILIKVNQIGTLTETFDAIEMAKRAGYTAVISHRSGETEDSTIADIAVATNAGQIKTGAPSRTDRVAKYNQLLRIEDQLAETAQYHGIQSFYNLNK

SEQ ID NO: 7700 - protein, 511 aa, Bacillus licheniformis
MSNKLAALIILDGFGLRDETVGNAVAQAKKPNFDRYWNKYPHQTLTASGEAVGLPDGQMGNSEVGHLNIGAGRIVYQSLTRVNVAIREGEFEQNETFLAAMKHVKEKGTNLHLFGLLSDGGVHSHIHHLYALLKLAKKEGVENVYIHGFLDGRDVGPQTAEKYIKELQDQIEEIGVGEIATLSGRYYSMDRDKRWDRVEKAYRAMAYGEGPKYQNPLDVVKDSYENGIYDEFVIPSVITKENGEPVATIKDNDAVIFYNFRPDRAIQISNTFTNDDFRDFDRGDKHPKNLHFVCLTHFSETVDGYVAFKPVNLDNTVGEVLSQNGLKQLRIAETEKYPHVTFFMSGGREEKFPGEERILIDSPKVATYDLKPEMSAYEVKDALVKEIEAEKHNAIILNFANPDMVGHSGKVEPTVKAIEAVDECLGEVVDAILAKGGYAIITADHGNADVLITEEGKPHTAHTTNPVPVIVTKEGVTLREGGILGDLAPTLLDLLGVEKPKEMTGSSLIQK

SEQ ID NO: 7701 - protein, 253 aa, Bacillus licheniformis
MRKPIIAGNWKMNKVLSEAVSFVEEVKSSIPAADKAEAVVCAPALFLEKLTSAVKGTDLKVGAQNMHFEESGAFTGEISPAALKDLGVEYCVIGHSERREMFAETDETVNKKAHAAFKYGIVPIICVGETLEEREANKTNELVADQVKKALAGLTTEQVAASVIAYEPIWAIGTGKSSTAQDANEVCAHIRKTVASEFGQTAADSVRIQYGGSVKPANIKEYMAESDIDGALVGGASLEPQSFVQLLEAGQYE

SEQ ID NO: 7702 - protein, 394 aa, Bacillus licheniformis
MNKKSVKDIDVKGRVVFCRVDFNVPMKDGKVTDDTRIRAALPTIQYLTEQGAKVLLASHLGRPKGQVSEELRLTPVAARLGELIGKEVKKADEAYGDAVKAQISEMKDGDILVLENVRFYPGEEKNDPELSKAFADLADVYVNDAFGAAHRAHASTAGIAEHLPAVAGFLMEKELEVLGKALSNPERPFTAIIGGAKVKDKIGVIESLLEKVDNLIIGGGLAYTFVKALGHEVGKSLLEEDKIELAKSFMDRAKEKGVNFYMPTDVLVADDFSNDANTKIVPVSEIPSDWEALDIGEETRKTYADVIKNSKLVVWNGPMGVFEIDAFAKGTRAVAEALAEANDTYSVIGGGDSAAAVEKFGLADKMSHISTGGGASLEFMEGKELPGVKALNDK

SEQ ID NO: 7703 - protein, 335 aa, Bacillus licheniformis
MAVKVGINGFGRIGRNVFRAALNNPEVEVVAVNDLTDANMLAHLLQYDSVHGKLDAEVSVDGSNLVVNGQTIQVTAERDPSKLSWGEQGVEIVVESTGFFTKRADAAKHLEAGAKKVIISAPASEEDITIVMGVNEDKYDAANHHVISNASCTTNCLAPFAKVLNDKFGIKRGMMTTVHSYTNDQQILDLPHKDYRRARAAAESIIPTTTGAAKAVSLVLPELKGKLNGGAMRVPTPNVSLVDLVAELDKEVTAEEVNAALKEAAEGELQGVLGYSEEPLVSKDYNGNTNSSTIDALSTMVMEGSMVKVISWYDNESGYSHRVVDLAAYIAKQGL

SEQ ID NO: 7704 - protein, 346 aa, Bacillus licheniformis
MNQLIQAQKKLLPDLLDVMQKRYKILQYIRLTEPIGRRSLAASLGISERILRAEVQFLKEQNLLEIKTTGMILTPEGSDLLKVLEDTMKDVLGLTHLENTLKERLNLDEVIIVSGDSDQSPWVKKEMGRAAVACMKNRFTGENIVAVTGGTTLEAVAEMMTPDSKNRKLLFVPARGGLGENVRNQANTICAHMAEKASGTYKLLFVPGQLSKEAYSSIIEEPSIKEVLQTIQSSSMVIHGIGDAKTMAERRNTPKEDLKKIEENEAVAEAFGYYFDRHGEVIHKVHSVGIQLEDLDSIPNIIAVAGGSSKADAIEAYFKKPRNTVLITDEGAAKQLLREASSLNIN

SEQ ID NO: 7705 - protein, 335 aa, Bacillus licheniformis
MSEQHFKNTKYSVLNLSPIVQGGNAEQSFKQSMDLAQHAEKWGYHRFWLAEHHNIEGVASSATSVLIGYIAGGTKKMRIGSGGIMLPNHSPLVIAEQFGTLESLYPGRIDLGLGRAPGTDQLTARALRRNISSGEDFPEQLEELRQYFKPSGNVRNHVRAIPGEGLDVPIWLLGSSGFSARLAGELGLPFAFAAHFSPANTLPALELYRSSFKPGVLKEPYAMVGVTVIAADTDAKAQRLATSHYQKFLDLVRGAPTQLKPPVDDMEQIWTPREKAMVNEQLSSTIIGGPDSVKEKLEEFIRTTQANEIMINSETFDHADRLRSFEIIADVWKNG

SEQ ID NO: 7706 - protein, 455 aa, Bacillus licheniformis
MEKDMQKLERTMTSRHIMMMALGGAIGAGLFKGSSKAIDLAGPSVMIPYLIGGVILLFIMQGLAEMAVRNSEARTFRDLVQSILGPYAAYFLDWIYWKMWVLNIAAEAVVAAMFLQYWLPGLPIWVLALFVSLVITSVNLLSVKSFAETEYWLALIKITVIVVFIISGFILLFFSFGQHSAVGFTHLTDHGGFFPNGAGGLITAMLVVIYSYGGTEIIGVTLAETKNPEKVVPKAVRGTLTRIIAFYLLPFFVIVSLIPWNQVNGVSESPFVMVFKMIGVPGADHLMNAVILLAVISSMNSGLYGASRILYTQASDGRMPKIFSRLSARKVPVYSILLCTSFLYLGVLFSLFAGSQTFEYLMGSLGYTVLVIWMLIAAAHLKSRKRNQTAGNGYYVKWFPYTTWVAIISLTAILIGVILTTSIVITLVTAGIYLLISAAYFFKGRNQTAGQTAAS

SEQ ID NO: 7707 - protein, 157 aa, Bacillus licheniformis
MKKLLFMVILSVLTLVFGSSSVSFAKDIPEDRYTTPTDAEFSQIKEILNEADVETGNLQKDYGVIVNDPAEKVGVISDIPAEKDDWSHVSFHSYYVDLNSGTLIADVQFEFTQNDDGTSETEYKNVTNGGRYFVKMDQDGNVIDEATTGDMSILWKY

SEQ ID NO: 7708 - protein, 308 aa, Bacillus licheniformis
MNVVIEAKGLMKSYGAKTVVNHVDLQVEKGEIYGFLGRNGAGKSTFMNMITGIIQPTAGSFLLLNEASIESVKHRIGVLPDYLTLYDSMTAVGHLKYFAKLNGRTVSTERCEEVLERVGFTEHTEKKAGAYSFGMKKKLGIAQAIIHDPELIFLDEPTSGVDAESALHIQKLIMDLQKEGKTVFMTSHNLHEIEKICTRIAIMKNGRILMEGTLDELRRHFMSNISVHIRHSNIPEQHFGLIDRFLESAGENVQFKHHEISIIVNSEEKIPAIVRVLTNCKVGIYRIHVDEPSLEDIFIDSSEERVVS

SEQ ID NO: 7709 - protein, 229 aa, Bacillus licheniformis
MRAVCLNEFISLFKSIKSIIVIIIMFWVSYKTAGLIEQAPADVVRELDLGSDAGAIGTAVIVFALGFLFIAGLSHDMINREVHTRTVRFLVTKTSRIKIILGKFLGVWLFWFFCMLVSYALVMIASKEFLWLSYADSMAFLTAAISLNLLFSIVISRPAVSMFFGIVFALVFPAVSLWAVYSENGMITWFKYITPYYYSVLGGSFIFINFVYAAIVLCGAIVLFKRRDL

SEQ ID NO: 7710 - protein, 240 aa, Bacillus licheniformis
MTNGTIHNKDGFLNRIAERLGRNRRSAGVTVPDYIHQPQHRVYQGYTQDELVGVLKDHCRKIHTELIETDVIGLHDALYEQAARFGGGPVMIPKDDRFKEYGLSGLLTDKWPNEGTKVWEWDAAAGDENIQRAEQANIGVTFSEITLAESGTVVLFSSKDKGRSVSLLPTTYIAIVPKSTIVPRMTQASAIIKQKIADGDVIPSCINYVTGPSNSADIEMDLVVGVHGPVKAAYIVVEDR

SEQ ID NO: 7711 - protein, 477 aa, Bacillus licheniformis
MAMKIGTQKFKERVSDGLDNEFMRGAVSSAQERLRARRLEAAKELGNWEEWRSLAEEIRQHVLENLDYYLEQLAENVAKKGGHVFFAQTAEEATGYIRDVVKKKNGKKIVKSKSMVTEEINMNEALESDGCEVVETDLGEYILQIDDHDPPSHIVAPALHKNKEQIRDVFKERIGYRNTEKPEELVMHARAVLRKKFLEADIGITGCNFAIADTGSVSLVTNEGNGRLVTTIPKTQITVMGMERIVPSFDEFEVLVGMLTRSAVGQRLTSYITALTGPRLPGEADGPEEFHLVIVDNGRSNILGTEFQSVLQCIRCAACINVCPVYRHVGGHSYGSIYSGPIGAVLSPLLGGYDDYKELPYASSLCAACSEACPVKIPLHELLLKHRQRIVEKEGRAPISEKLAMKAFGLGTSAPSLYKMGSKWAPAAMKPFKEDGKITKGPGPLKQWTQIRDFPAPNKSRFRDWFEDRRKEKGEDK

SEQ ID NO: 7712 - protein, 238 aa, Bacillus licheniformis
MKVSLFITCLVDMFQSNVGKATVELLERLGCEVDFPEGQICCGQPAYNSGYVKDSKKAMRRMIETFESAEYVVSPSGSCAFMFKEYPHLFRDEPAWAEKAQRLADKTYELTDFIVNVLKIEDVGATLEKKATYHTSCHMTRLLGVTDAPMKLLRHVKGLEFTPLPRKHDCCGFGGTFSVKMSQISEQMVDEKVACVEETAADVLIGADCGCLMNIGGRIGRKNKPIEVMHIAEVLNSR

SEQ ID NO: 7713 - protein, 246 aa, Bacillus licheniformis
MKYKQIKTKKIYEEVAEALLESIKSGELEPGDKLDSVQALADSFQVSRSAVREALSALKAMGMVEMKQGEGTYVKRFEPEQISIPLSAALLMKKKDVAELLEVRKILEIGAVSSAAQKRTEDDLGRMQEALEDMKLADGNGELGEKADLAFHLALAGASQNDLLKGLMNHVSSLLIETMRETRKIWLFSKNTTVKRLYEEHEAIYQAVKEKDGQKAEQAMHNHLTNVENVLASYFEETKQADEPAI

SEQ ID NO: 7714 - protein, 563 aa, Bacillus licheniformis
MGWTQDYTPLGNSLLLSSLAALIPILYFFWALAIKRMKGHTAGLTTLLIALVLAVFVYGMPAQQAVMSASQGAVYGLLPIGWIIVTSVFLYKLTVKTGQFEIIRSSVLSITDDRRLQALLIAFSFGAFLEGAAGFGAPVAISAALLVGLGFNPLYAAGICLIANTAPVAFGAIGIPIIAVEGPTGIPAMDISKMVGRQLPFLSVFIPFYLIIIMSGFKRALEVLPAILVSGVSFAVTQYVSSNFLGPELPDILSAIVSLIALAVFLKFWKPKTTFRFSQEKEMAAAAEAQQLEHQKASYSAGQIFKAWTPFLLLTAMVSIWGIPSVKQALTGHYEGSNPLLLFINDIGGRLTFAPGVPFLHNQILDGSGKPLEALYKLDLAGSAGTAILIAAVLTKFVTGMPWKEWGAVFTDSLKELGKPILTIASVVGFAYVTNSSGMSTTLGMSLAMTGSMFAFFSPVLGWLGVFITGSDTSANLLFGSLQKMTAQSVGMEPVLSVAANSSGGVTGKMISPQSIAVACAAVGLAGKESDLLRFTLKHSLFLLFLVCMITFLQHHLFSWMIP

SEQ ID NO: 7715 - protein, 436 aa, Bacillus licheniformis
MNLHVQQQQTAKLHLTQGLAQAIHMLQYSSAELNSRIDELSLENPLIERKDSDIPRSFYHKTNRHLQNEGISRSETAHSREDVKSALKRQALDLQLSSREKRVFSYLVESLDPNGYVTEDIAFIASELAVTREEAEEVLGKLQTLDPAGIGARSLQECILIQLKRLPKETAKAEKVISSYFDLFAKKGWKELSERAGLSLSELQDIQDLVAELSPRPGLIYGTDDGEVYVEPDLIISAEDGKLVLELSSRSFPDIQLNAFYEPFLERQSKDEATAYISDKFKQWKWLDNALRQRRETMRRVMAEIMVRQKDYFLKGKDELKPLTLKEIADALGVHESTVSRAVKGKIVQTPFELCELKRFFSAKVKDAADGHASSHTVKAHLRRLIDEEDKMKPLSDQKLADLLNEKHGVVISRRTVAKYRDQLNILPSSVRKRYQ

SEQ ID NO: 7716 - protein, 71 aa, Bacillus licheniformis
MTELFSVPYFIENFKTHIEMHPNEDKIHAMNSYYRSVVSTLVQDQLTKNAVVLKRIQHLDEAYNKVKREEA

SEQ ID NO: 7717 - protein, 325 aa, Bacillus licheniformis
MAITYSMDSLKHKLAEILDVIPRHSSVVYLDYPLYGNVGDLLIMKGTEAFFEAYGIKVRERWNAENFIPGRRIPKDAIIVCQGGGNFGDLYPHFQQFRERVVEHYPDNRIVILPQSIYYEHEENIIKTRGILAAHPDLHLFTREKASFDFAVKRFEEVKNIKMMPDMAHQLWPIAAPAEKPSESVLRLIRTDKEANSSLQKAGEPDTYDWNVILSEGDKRGIKRLQTINVLNKKAGNPLPIASYWKRFSDSLVDKSIRFFSRYESVVTSRLHGHILSCLLGKENVVIDNSYGKNANYYNTWMKDIPNTKLIQNHQTEAEKPPVHV

SEQ ID NO: 7718 - protein, 381 aa, Bacillus licheniformis
MSQNKRIYLSPPHMSGDEERYVAEAFRTNWIAPLGPLVDTFEEKLAAYAGTSGAAAVSSGTAAIHLALKLLGVGKGDTVFCSSFTFVASANPIIYEQAEPVFIDSERDTWNMSPEALERALDEAERARNLPKAVIVVNLYGQSAKMDEIMAICDRFAVPVIEDAAESLGSVYKGRKSGTFGRFGIYSFNGNKIITTSGGGMLVSDDEDALKKARFLATQAREPAIHYQHEKAGYNYRMSNVLAGIGIAQLAVLDDRVHARRAVFERYKEALSGIEGIEFMPEAGMSNRWLTTLTLDTAKIQTTPADIIEQLANENIEARPLWKPLHRQPLFKGAAFYPHDDQGSVCCDLFQRGLCLPSGSSMTRKEQDRVIQIVADRIKYK

SEQ ID NO: 7719 - protein, 208 aa, Bacillus licheniformis
MQNVVIIGAGGHGKVVRELVKERPDTELAGILDDRYAELHVENGLYRGPSAAAEELARLHPDAKFVLAVGQNSIRQQLYERIGLPLDRYAVLIHPSAVVSGSARIQNGAVVMASSVIQADADVGIHAIVNTGAIVEHDNRIGDYVHLSPGTVLTGGVTVMEGAHLGAGTAVIPGKTVGRWSVTGAGAAVIHDIPDNCTAVGVPARMIK

SEQ ID NO: 7720 - protein, 200 aa, Bacillus licheniformis
MLAKRFFDLALSVILLVALSPAMILTACLIRWKIGSPVLFRQTRPGLNGEPFTLYKFRTMTDERDAAGNLLSDEKRLTKTGRLIRKTSLDELPQLINVIKGDLSLVGPRPLLMEYIPLYTKRQWRRHEVKPGITGWAQINGRNKVTWEEKFELDVWYVDHRSFLLDLKILLLTVVKVLKSEGVSQDRHVTAEKFTGRRNA

SEQ ID NO: 7721 - protein, 397 aa, Bacillus licheniformis
MGDVQVALLIGSLLFLLTFVMSGFAAGPFFANKIYITSTIQAIQMLIRVLSVLLIFAWFAPKIWHIQLAALIATASACILSIFFFKRLIPWFTFRVRDMSFAKCKKLLQAGGWSSVSQVGILLFLQIDLMVANVMLGVSESGMYAAIIQFPLLLRTLSGTLAAVFSPTITLYYSKGDKEGLVRYANQAVRFNGILLALPAALLGGLAGPFLSLWLGPSFEHLKWLLLIHAGYLVVSLSPAPLFYIFTAYNKLRTPALTTVAFGVVNLLLAIVLSGPAGLGLYGIALAGAAALTLKNVVFTPIYASKITGERKRVFYKGIYGPVAGASFTLAVCYALQYLFSIVSLLSLFVTALAATLAYGLFAYFVMLTKAERRIVTTKLQAYRCSLSFPFQKGFFK

SEQ ID NO: 7722 - protein, 127 aa, Bacillus licheniformis
MNKTFVLNLGANMASFLLSVLFSMWLTPYVIKTLGVEAFGFVHLTQNMINYFSIITVALSAVVVRFFSVSAHRGALDEARGYMNTYIVSSLVLSVILFFPLGGTVFFIDQIIRVPAGLFWGMCRSRF

SEQ ID NO: 7723 - protein, 339 aa, Bacillus licheniformis
MKPFISIIVPMYNVEDYIEECVDSLRRQTLKNIEIILVDDGSPDRSGEIARTYCSLDARVKVIHKKNGGLSSARNAGLQAATGDYVGFVDGDDFVLPAMFENMYAAAKKDDLDIVMCGYHKHSDTEDAYFPPPLPTDRLLLSWDIKRELKKAHETRFIWYVWRNLYRRDLLKKNQLYFFEDIRFAEDSPFNLYAFYAAKRVRAIDEGYYMYRCNPDSLTEAPFKPYMDESLKRQYRAKRRFYETFQLLDECADDLETYTCKHQIPMLLANACAEPKPSKQVRRHIKDILSYRMVQSCVKATSLRNRNLLIGQRLVLLLCKLNIPILLELFFKRNLPSKG

SEQ ID NO: 7724 - protein, 359 aa, Bacillus licheniformis
MTFQELKINLAEWLLLKVKYPSEYVMGTPGLRRFEQYKGKKKIILTLIPSHDNLGDHAIALASRTFIENEFPDFELIEIGINDIYKHAKALMRIRHPEDMVFIIGGGNMGDLYRNEEWTRRFIIKTFKHYKIVQLPATAHFSETLRGKKELKRAKKIYNSHRRLFMMARDDTTYQFMKQHFSNQTIVKQPDMVLYLKKEQQSEREGVLVCLREDKESFLRPEERKKLLKAVGDEYGGAKTFTTTIGRRVSRVSREKELNRLWDQLRGAEVVVTDRLHGMIFCAITGTPCVVIRSFDHKVLEGFRWLKDVPSMKLVENPDAAEVLGAIEELVKTGDSHRETPARDHYFADLRRKIMGDVQ

SEQ ID NO: 7725 - protein, 343 aa, Bacillus licheniformis
MENPAVSLLVAVYNTEAFLPNCLQSLISQTLKNIEIIIVNDGSTDGSQKIIDHYARKDGRIKTIQQDNQGLGAVRNKGIEAASGEYLAFIDSDDWIEPDYCQSMYEKAKDEDADLVICDYAVEIQDTEKTVCPDIGKNYEGKPKEAFMKDLLKGKVSGFSWNKLYRRSLIERHKLVFPLRDELENIEDQYFSFRCLLYANTAAFVTKPLYHYRVHLASIVQKYQAGLFEDGLALYEANLDCLTKHGELPALKEALHVFIVNHGCISILNECKSRNKNPSIEKYKNIRSICACPEFRGKISAVDMSAFDSKKKLLLMLIRLRLMPAVYGFAAIYQKMIEHRMKK

SEQ ID NO: 7726 - protein, 367 aa, Bacillus licheniformis
MAVYMLNMGIVFVWSWFAKMYGREDHRLPTGYRPNAILTVVPLASLIIVAGLRYKVGTDYHTYMLLYELAGKYNSIWEIFGFGTGKSSTDPGFTALLWILNQISADPALMFAVVAAITYIYIVKTLYVYGRPFELSMFLFIGMFHYYASFNGIRQYMAAAILFWAVRYLIDGKLVRYMIVVLICSLFHSSALIMIPVYFIVRRKAWSPVLWCLMLVFLAGTFLYQKFLSVFLVVLENSQYGHYEEWLMKNTNGMNVIKIIVLLLPLALAFCFREQLRKRWPEVDYIVNLCLIGFLFGILATKDVIFARFNIYFGLYQLILVPYFVRIFEPKSNALLYVLILICYFLYSFMLMPFDSSVLPYRTIFER

SEQ ID NO: 7727 - protein, 386 aa, Bacillus licheniformis
MNDGSVRPKRVLHIVSGMNRGGAETMIMNIYRHTDRRHIQFDFISHREETCDYDPEIITRGGRVFYVPSIGRSGPVAYIKNIRRILVEKGPYAAVHAHTDFQTGFAALAARLAGVPVRVCHSHNTAWKPNPRFWDTWQLLAFRRLIFSSATALCACGKDAGRFLFGAKKMGENAVHLLQNGIELDRFKEANGVSKTNAKKSFGIKEDALVIGHVGRFFEQKNHAFLLGLAAYCKKSGIPFQAVFAGDGPLRRQMEEKAAALGVKDDILFLGVVEDIPALMQAFDVFVMPSLFEGLPLVLVEAQASGLPCIVSDNITEETDLGLGLLQRLSLNAGFERWAEDISRAAQPKKPAWPEIERSLAERGYDAKANLARLMDIYSISAAEGQ

SEQ ID NO: 7728 - protein, 280 aa, Bacillus licheniformis
MIGGQKPKVSVIMGVYNCENTIAESIESILNQTYKNWELIICDDASTDGTYAVARRYADHYADKIKLIKNEKNQRLAASLNHCLQYAGGKYIARQDGDDISLPRRFEKQVAFLESQSHYHVVGSGMMAFDENGIRGVRMLPSSPEPRIMAKGTPFCHATIMMRADVYEALDGYRVGRRTRRMEDVDLWLRFFEAGFTGYNLQEALYKVREDESAFKRRKLSYSIDNAFIVFAACRRLKLPLSDYIYTMKPIIRGLMPPFIMNRYHKRRLMNEGGGVVKHE

SEQ ID NO: 7729 - protein, 382 aa, Bacillus licheniformis
MTRTVLFCATVDYHFKAFHLPYLKWFKEQGWNVHIAAKGDMTLPYTDKKFDIDIRRSPLNASNIAAYRELARIIDEHRYSIIHCHTPMGGVLARLAARKQRKEGTKVIYTAHGFHFCQGAPLKNWLLYYPIEKGLSALTDCLITINEEDFVLAKGLRKALRTEKIHGIGVDTERFHPVSETEKMLLRKTYGFKEDDFILIYPAELNANKNQALLIETAAALKDRAPNLKVVFAGKGQMEQKYRNHAEQKGVSSLVMFAGFQKNIHEWIQLADVSVASSIREGLGMNLLEGMASGKPAVAADNRGHREVIQEGVNGFLVPQGDAGTFSDRILQLYRLPSLRKKMGDAGRRTAAAFSQQRTVKEMAGIYSSFMDNETVERRLKG

SEQ ID NO: 7730 - protein, 605 aa, Bacillus licheniformis
MTYRRRLSIITALDSYLVLLSIFIGYQLILPSYDLYPSEMLLMTSLILLGAQHLFAHCFHLYKKVWEYASIGELYVLLKSITLSHLVTAALELFFFQNVPVRLLCLSWLFQLILIGGSRMMWRIIREQVNKESKGSLRALIIGAGSAGSLIAKQLVQKPELNIKPVAFIDDDKTKYRLEIMGLPVLGGKEQIMQAVRQWNIDRIIIAIPSLSVTQMQEMYKACAQTGVKTQIMPKIDEILLGRHPVGQLRDVKAEDLLGREPVQLDTSEISNTVKDRVVLVTGAGGSIGSEICRQISKFKPKSIILVGHGENSIHSILLELKEKFGKHVAYYPEIADIQDREKMFLLMERYKPNVIYHAAAHKHVPLMEKCPKEAVKNNILGTKNVAEAADETEVETFVLISSDKAVNPANIMGATKRFAEMLIMNLGKTSKTKFVAVRFGNVLGSRGSVIPIFKKQIAKGGPVTVTHQDMTRYFMTIPEASRLVIQAGALAKGRQIFVLDMGEPVKIVDLAKNLIQLSGYTTEQIKIEFTGIRPGEKMYEELLNQNEVLAEQVFPKIHIGKAVDVEWTVLKSFMDEFMYLSDRELRERLFKAIGQHEKKLVTAH

SEQ ID NO: 7731 - protein, 230 aa, Bacillus licheniformis
MGIRKKRSRKYQSALVALHQPNTPIVEQYRTIRTNIEFSSFEKPFKSLLITSGLPGEGKSFSASNLAIVFSQQEKKVLLIDADLRKPTIHKIFELDNHSGVTNVLMKKSTLENVVQQSQAENLHVLTSGPIPPNPSELLSSQAMEDLLAEAYDQYDLVILDSPPLLPVADAQILANQVDGSILVILSGKTKLDNAIKSRDALNSSKSELLGAVLNGRKVKKARQYNYATM

SEQ ID NO: 7732 - protein, 250 aa, Bacillus licheniformis
MKENIDFRELIAILRKRTVLILVLTIGVTLTTGIIQFYVLTPVYQASTQILVHQVGEKKGSATYSDIQINLQYTRTFQALLKNPVILEQVKRELDLPYSAGRLGEKIATSSESESEIINISVQDENQKRAADIANTLTAVLKKEIKQIMNTDRVTVLSKAEIVDSPTPVRPNYKMNILLAFGAALMTGIALAFFLDFIDDTVARPSQVEKEAGFIYLGSIEQMKHKKSLFRGDPDMNIRVKAGRSEPLGY

SEQ ID NO: 7733 - protein, 152 aa, Bacillus licheniformis
MIGRVIRMYRKRKGYSINQLADIAGVSKSYLSKIERGVHRNPSVEFLKKISRALKVELKELFDTEVILYRRTEQEDEWRTHLVQAVQAGMNQEELFQFTHRLKQKKKERALYRNRELTRANIDEWRALMLEAKEMGLTVKEVEAFLMRTKNH

SEQ ID NO: 7734 - protein, 174 aa, Bacillus licheniformis
MKVLVLAFHPNMEQSVVNRAFADTLKDAPGITLRDLYQEYPDEAIDVEKEQKLCEEHDRIVFQFPLYWYSSPPLLKKWLDHVLLYGWAYGTNGTALRGKEFMVAVSAGAPEEAYQAGGSNHYAISELLRPFQATSNFIGTTYLPPYVFYQAGTAGKSELAEGATQYREHVLKSF

SEQ ID NO: 7735 - protein, 426 aa, Bacillus licheniformis
MNHPIQKKSNVRWVVAFMMWAAIAINYIDRTVLSAAAPYITEEFNLTPGQMGIIMSGFFWSYALLQLPSGWAADKYGQKKTLGFAVVWWSVATALTGLATGFKSLLGLRVALGVGEAAAYPSNAGIAAKWFPKKERATVAGIFDSGSKFGGAVAMPLIAWMIAVFDWKLTFLLIGLVGVAWGIVWMIFFKENPADHKRVNEAELAHIREGQAHMEETGGGQPLKWYQLFKYRNIWAMCIGFFMINYNSYFFITWLPTYLVKERGMDLIEMGIMASLPLLTAMVVEVGAGWMSDRIYAKGKLSLTAVRKLFLIIGLVMASCIGFAAFADSAILAVILLCVAKSGTTVAASQVWALPGDVAPKNMTSMVAGIQNTVSNMGGVVGPIITGFIVGATGSFVPALLFSAALIIIAILNYLFLLGKVKQIQV

SEQ ID NO: 7736 - protein, 316 aa, Bacillus licheniformis
MKVVCTSPSFAKYSDDPVLFLEKKGMSLERLPADITEEQFIEAAEGADAAIVAFNQITPYVLDRLPSLKIVCKHGVGVDNIDLHAAKERNVWVTNAPNANKHAVADFVFGLMLSAARQIPAADRETKLGKWPRIFGSDVYGKTLGIVGLGMIGKEVAKRAQGFNMTVLAYDVFPDRAFAADHHIHFTELDQLLKECDFITLHMPLTAETENMIGEKELAAMKETAYLINASRGGIVSECALYDALASGGIAGAALDVYQTEPLKQHPLFELDRFIAVPHIAGYTRDAVQNLGMICVKNIASVLIDKQKPEFVVNGL

SEQ ID NO: 7737 - protein, 332 aa, Bacillus licheniformis
MKKPVIGITMGDAAGVGPEIIVKALTSREVYDMCRPLVIGDMKMLKKAAFQIGSEVVINKVGHPDEGGFVHGKIDCLDIELLPENLPVGKVSAEAGNAAFHFVKKAVELAKKGCIQAICTAPLNKEALHKGGHRYPGHTEILAHLTNTTDYSMMLASPKLKVIHLTTHQGLIEAIQSITPERTYKVIRLAHDTLTRAGFEQPKIAVCGINPHAGENGLFGSGEEERQLLPGIEQAAAEGIDAGGPYPADTLFYKAVRGDVDLVVACYHDQGHIPVKVLGLEEGVNITVGLNGGIIRTSVDHGTAFDIAGQNKADERSMLAALRSAAELAPKS

SEQ ID NO: 7738 - protein, 423 aa, Bacillus licheniformis
MKIAIIADDLTGANDCGGQLVHYGMDVSVKLDAEFTRRETEGVVIFNTDSRSLPAAEAKATVKNISEHISRQSFDIVYKKIDSTMRGNIGAELQAMYEVFQPDFVLIAPGYPQNGRQVIGGIHYVNGVKLEETEAANDPKTPVAESNIQRLIEKQTRNKSGHLSYEDIRRGHGHVRNKLERFRAEGISYVTADSVHESDLQGLALILESLPYSIILAGSAGLMSCLPKAFNLKERELGQTVPSSDQPIMFVVGSMSRTGREQLHELFAGRAAEKIEMRSERVLCGGAEKRNEFERLKERAADVQRRSKHIVLCTSDNAAETQKIGESRGLTPVQTSNAVSGALGEFAGELIQAFHVKRLFLTGGDTAYQVLHQLRIHEIRLLDEVEPGIPLGAAGEELYIVTKAGNFGSRSVMASAAIKLQGG

SEQ ID NO: 7739 - protein, 388 aa, Bacillus licheniformis
MPANYQFRTAGHIVAGEHSIRRLKDHVRTIVPKADRALIITQPSIVKLGAIGEVQAQLTEIGIQSDVCTAILPEPTVQNIEDVFRGIREKRYDILIGIGGGSVLDGTKILSVLQTNSKKVEELLGTDLVEKPGIPTVLIPSTSGTGAEVTPNAIVTLPEEELKVGIVSPLLLPKLVILDPVITLGLPKPITAATGMDAFTHSLESFISTKANPISDMFALESIRLISASIVEAYENGSSIQARENMLLGSTYGGMALTAAGTAAVHALAYPLGGKYRISHGVANSMLLPHVMEFNMDAITERLSLAAETMGIVASDLTAEQAAEAVVQKIREWTERLNIPQDLKAFGVTASDVDDLADSASKVTRLLHNNPKPLSLENIKDIYRKLIN

SEQ ID NO: 7740 - protein, 295 aa, Bacillus licheniformis
MGFVPKGIYPAMLTPLTKDQSIDESALKQLTNHLIDAHVHGLFALGTNGEFHMFNIEDKLKVAEIIIQETAERVPVMVGSGGNSTEEAIWLSKEIERLGADALSVITPFFIPPTQEEAAVHYKTIAASVSLPILLYNIPSKTGFHLEPETVAELAKVDNIVGIKDSSGNFENIQQYIEQTKNDDFSVFAGTDSLILKTLQAGGAGAVAATANMLPDIVTSIYHHWAEGETEKAEAAQMELQPLRDTFRLGTIPAALKKAVELYSIPVGPPKAPVKELTGPALLEVEKMVASYQSK

SEQ ID NO: 7741 - protein, 572 aa, Bacillus licheniformis
MKVMAIAPYEGLKELMVQVAGGENFEFEAASGDLEKGVELAKQAEANGTDLIISRGGTAELIQQEVSIPVVDIEVSGYDMLRVLTLAKGYPGKAAIVGFPMIADGASAVCEILDIRIDACTVSDERDVEPVLLQLKEQGYQIIIGDVITIEKAEQLGLNGLLLTSGKESIAKAFAYAKKLYSFLESIKQKYAVPYHILQKAETGYAVYNKTLRPVFQNGVFAEHIGLLDNLEELIGEAEKKGVIHFRLRKHGRTWNITGRRFFVSDEALTVFTAENAKDVRVSSLPGATILSPLRMSYMETSRNETMQKVLKKAELFSARREPVWINGAPGSGKESLAGLIHMKGEDKHEPFRKIDAGLLSEAEWEQACESEEFFSGRGTLYIKQVDRMPPSSQRLLLRRISEPYDGPRLIVSSSRRRAEEFSSDLYDALCHLELDVPPLSERKEDILHLAYLFIAESNEAFGKQIVGFRNEAGVLLEEAKWPGNLSQLRKTVQNCVLEAQGVYIEKTDAERVLSRLNEEEREDIDLSGTLEEIEKRIIQKIYAEEGNNQTRTAERLGINRTTLWRKLKSSD

SEQ ID NO: 7742 - protein, 107 aa, Bacillus licheniformis
MNSAVDHKECSSLIQDVLKIFSGKWSFLVLAELIQGKRRFNELRRNLGNVNTKGLTDTLRHLEESGMISRKVFPTVPVTVEYKLTEKGKEFHSIFKEMAAWGGKWLP

SEQ ID NO: 7743 - protein, 364 aa, Bacillus licheniformis
MKKQYESLFTPFTFKNGIQLKNRIIMPPMGHSSSLPGGFISDDELVYYAARATEVGMVITSATTVQPGTGFPGIPGAENDDQIPGLTRLAATLKKHGAKAILQLFHPGAKGIERTVSASAVAPNQPNAPVPRALSEQEIQDLIHSFGQTARRAIEAGFDGVEIHGANGFLIHQFFSPYYNRRNDGWGGTLEKRMRFPLQIIEEIRRVADSCHKPSFIIGYKFSPEEPETPGITMDETLSFVNVLREQGLDYLHVSLVDFRSLPRRGADRSRARMELIKEAVQDRLPLIGAGQVHTPEDALQALETGADLIGIGRGLLMDPEWLQKVRAGKEDDIQTTLSRHDQRKLAIPDAFWESIPMYIDFSD

SEQ ID NO: 7744 - protein, 482 aa, Bacillus licheniformis
MNIKNIAKKASALTVAAALLAGGAPQTFAKETQDYKKSYGFSHITRHDMLKIPEQQKSEQFKVPQFDPKTIKNIPSAKGYNKNGELIDLDVWDSWPLQNADGTVATYHGYNLVFALAGDPKDVDDTSIYLFYQKKGETSIDSWKNAGRVFKDSDKFVPDDPYLKHQTQEWSGSATLTKDGKVRLFYTAFSGTQYGKQTLTTAQVNFSQPDSDTLKIDGVEDHKSVFDGADGTVYQNVQQFIDEGNYSSGDNHTMRDPHYVEDRGHKYLVFEANTGTKTGYQGEDSLFNRAYYGGSKKFFKEESSKLLQGANKKNASLANGALGIIELNNDYTLKKVMKPLIASNTVTDEIERANLFKMNGKWYLFTDSRGSKMTIDGIGSKDIYMLGYVSGSLTGPFKPLNKSGLVLHMDQDYNDITFTYSHFAVPQKKGDEVVITSYITNRGISNEHHATFAPSFLLKIKGSKTSVVKNSILEQGQLTVNK

SEQ ID NO: 7745 - protein, 515 aa, Bacillus licheniformis
MKKAVYKRISILTVCLGIFIMIFLSVRETEKKGESPDTPEYRAAFHLTTPDKWKNDPQKPVYFNGEYHYYYLYNRDYPDGNGTEWRHAVSDDLVHWQDKGVAIPKYTNKNGDPWSGSVVVDSKNTAGFGKGTIVAVMTQPSANDGKEEQFLWYSQNGGKTFKPYGEEPVLPNPGTVDFRDPKVIWDEQDDKWVMALAEGTKVGFYESQNLKEWRYTGSFQTENIGIIECPDLYKMRADDGTYKWVLGASANGKGTGKPNTYAYWTGSFNGNEFTADEAEPQWLDYGFDWYAGVTFEDGETNDPYEKRYALAWMNNWDYANRTPTWKDGFNGTDSIVRQIRLKHKGGDRYSLASHPIDQLDELTESADELDRIEVNGSKTLQIKGNTYQLEADISWDDLKNAGFRLRESADRKRHIDVGISAEGGYSYVNRGFTGQPDSTRTYLESKAPFDPEKKRVHFTIIVDQNTVEAFIDDGETTHSNLAFPDMNDTGITLFSENGTAVFENLKIKHLRSIRD

SEQ ID NO: 7746 - protein, 105 aa, Bacillus licheniformis
MGYVNLDKSNLTDQQRLVVASELQNKKKSKLIVFLLWWFLGGVAAHRFYLDERKGYAVAMLLLGWITLFIWPFIDGIICLVKTTDEVNEEIEQKIIASVLSKPAS

SEQ ID NO: 7747 - protein, 198 aa, Bacillus licheniformis
MNLIPTVIEQTNRGERAYDIYSRLLKDRIIMLGSAIDDNVANSIVSQLLFLEAEDPEKDISIYINSPGGSITAGMAIYDTMQFIKPQVSTICTGMAASMGAFLLAAGEKGKRYALPNSEVMIHQPLGGAQGQATEIEIAAKRILSLRDKLNKILAERTGQPLEVIERDTDRDNFKTAEEAKEYGLIDKVLTRNIDAQK

SEQ ID NO: 7748 - protein, 191 aa, Bacillus licheniformis
MKTVCVYSGSNMGADPEYKKKAAELGVYIAEKGLRLVYGGSRMGLMGVIADTVLENGGEVVGVMPKGLFTGEIVHQQLTELIEVSGMHERKAKMSELADGFIAMPGGFGTFEELFEVLCWAQIGIHQKPIGLYNVNGYFEPLLKMLEYSVQEGFSNKSHLELIHASASPAELIGNMNDYRYPVLEKKWKDL

SEQ ID NO: 7749 - protein, 124 aa, Bacillus licheniformis
MTITDAEQWTKAFYRERGWSEYGPFIRMGFLMEEAGELARAVRAYEIGRDRPDEAKRPAAELKKELIEEMGDVMGEFDHACRHIRCFIGRHDGCPSLQTDGTICRRASSRSMTAFTGRQIWSLC

SEQ ID NO: 7750 - protein, 313 aa, Bacillus licheniformis
MEPVLTDLIRSKAVQRLKGIHQGGASFLVNPAWNISRCEHSIGVMLLIRRLGGSLEEQIAGLLHDVSHTAFSHVADDVFNMENEDYHEQMFRQWVKQSDISGILHTYGFHDEDILYDEQKWTLLEQPAPSLCADRIDYTLRDSLAYGFGDPVEIGRFLETGLTVAEGEICCTSAEHAEWFARLYYQEVIDFFMNPLNIYALCTLSQMLKEALDMRVIAGRDFFKTDTELLAMLKQKARFRETLVKLSTASKRVKQGDEGDFTFHQTLKVRWIDPKVAVNGRKIPASTLSKNVLLMKETAIAAMKKGAYVKAAQ

SEQ ID NO: 7751 - protein, 539 aa, Bacillus licheniformis
MLRFSGRFEGYSLKRFQKDIVAGMVVGVVAIPLGMAFAIASGVKPEHGLYTVIVAGILISLLGGSKYQIGGPTGAFVPILFAIVLQYGFENLLIAGFMAGVILVILGLLKLGKIIKFIPRPVIIGFTAGIAVIIFTGEIAKFLGLRNVEKHESFYMNMREVVINLNTLSFYSILTAVVSLFFVLFTPKVLPKVPGALAGLLVSTVMATMLFPEQVVTIGSAYGEIPRSLPSFQFPELSLEKIIYLMPPALAIAMLGGIESLLSAMVADNMKGTRHDSNKELVGQGIANIAAPLFGGIPATGAIARTATNIKTGAASPISGIVHGVFVLLVLLLFAPYASLIPLASMSPILMVVAWNMSERKEFINILKIRNSDSAVLVVTFLLTVWQDLVFGVAAGILLAIITFIARMSKSFRIKKDVSESIVQSAAAAEEKHFQRSVSIYSVEGPLFFGSSNSLEDSILDKGHPPKLLILLMNKVDYMDSSAEGSLMTIVNRVHQQNGKVMIVGLQQQPRELLHKTGLFHKIGKKHFVDRPEQIFDVT

SEQ ID NO: 7752 - protein, 196 aa, Bacillus licheniformis
MAILTSILKHNQSFVEEKGYEFYETTKFPEKKLVILTCMDTRLLELLHHAMGLKNGDAKIIKNAGAVVSHPFGSVMRSILVAVYELQAEEVCVIGHHECGMASLNASSILQKAKQRGVDDGCLELLQHSGIDLDTWMTGFDSVEDSVSHSVNMIRKHPLLSSDVPVHGLVIDPKTGRLDVVEDGYSREDVSLSEVR

SEQ ID NO: 7753 - protein, 323 aa, Bacillus licheniformis
MKPFVYVTKPVPKEIEEMLAEHCEYEIWTSRERIPRTTLLEKIKEADGLLTSGTKIDRELLSNALKLKIVSNNSVGYDNFDIEAMKEKSVIGTHTPYILDDTVADLAFGLILSSARRIAELDRYVREGKWTKSEDDESLFGSDVHHRTLGIIGMGRIGEQVAKRAALGFDMEVLYYSRSRKPDTEKKTGAVYTGFHELLERSDFIVLVTPLTDETYRLIGEAEFKKMKPSSIFINISRGKTVDEQALIQALKEGWIKGAGLDVFEKEPIEKDNPLLSLSNVTLVPHIGSSTHVTHVNMLKSAVQNLIDGLQGKRPKDIVKELR

SEQ ID NO: 7754 - protein, 199 aa, Bacillus licheniformis
MEQNSKIIQPSILYYGTPVILLSTMNEDGSTNLSPLSSSWALGDSIVLGIGTEGKALENLERHAGCVINVPDSSLWRNVERLASYTGKRFVPEEKKRLGFTYLKEKFEAGGFTAADSLAVKPERVADCPLQIEAEAVNIRIPEHSPYFAVIETKVLHVHAHEAILKGEHHIDPQKWEPLIYLFRHYFGLGGELGKTFRA

SEQ ID NO: 7755 - protein, 231 aa, Bacillus licheniformis
MNVNPNIAEVAKLVTDPSRAAILTALLDDRYYTATELAGYAGIKQQTASFHLSKLLDAEMLTCRKQGRHRYYRLKNGKIAQSLETLLNIAPPAEIRSFRQSAEDRAVRKARTCYDHLAGSLGVTLADRLVEMGVLKEEETAFTVTEEGEAFLKELGIDVREVKKKRRSFCHKCLDWSERRHHIAGALGSALLDAFIRMGWIERRPHTRAVAVTPAGAKELYRLFHISIEKN

SEQ ID NO: 7756 - protein, 151 aa, Bacillus licheniformis
MKKILSTLALGFVLALGFLAGNLFTSSAEGPQAEKGGTVQSNEVINTFEGVADYIVKYGRLPDNFITKAEASKLGWDPQKGNLAEVAPGKSIGGDIFQNREKLLPDASGRVWREADINYTSGFRGSDRIVYSNDRLVYKTTDHYKTFTRMR

SEQ ID NO: 7757 - protein, 91 aa, Bacillus licheniformis
MKQVTLKGEKIRSVSDLHKELKEQLELPDYYGENLDALWDCLTGWVGMPLLIEWKNVEKSRIYLGDQAEAYLQLFREAEETLDGFQLKTEG

SEQ ID NO: 7758 - protein, 252 aa, Bacillus licheniformis
MTTMLDSLFKRIGYKPGQQVTFADLPEFLSLLALQFPFENGAVLRNERISMTKTELTEALLNNKRGGLCYDLNAFLYYVLTELGFSVHMVRGTVFNAKEQAWALTGTHVAVILREGDETYLLDTGFGINLPLAPVPFSGEPVPSKTGAYRIRETKTDKGDYLLEMDKGDGWQIGYAFSLTPIDEAVLTCVRDAIFDEKASPFNKNPLASKLIKDGKLILTKDHFTKQTGGGLTKEDVNAGDFQTIFVHSFFD

SEQ ID NO: 7759 - protein, 89 aa, Bacillus licheniformis
MVQQKVEVLLKTGLQARPAALFVQEANRFQSDIFLEKGDKKVNAKSIMGLMSLAVSSGSEVTLIADGSDEQDALDALTAYVQEKEAKPL

SEQ ID NO: 7760 - protein, 316 aa, Bacillus licheniformis
MSFASETKKELTNLEVKDCCAKAELSALIRMNGSLSFSNRKVVLDVQTENAAIARRIYTLLKKQYDVSVELLVRKKMRLKKNNVYIVRLIENAKPILEDLKILGDNFVIARNISEDLVKKRCCKRSYMRGAFLAGGSVNNPETSSYHLEIFSLYKEHNDSLCRLMNQFHLNSKTLERKKGYITYLKEAEKITEFLNVIGAHNSLLRFEDVRIVRDMRNSVNRLVNCETANLNKTIGASLRQVENIKLIDERIGLDALPEKLREIAQLRIDYQEVTLKELGEMVSSGKISKSGINHRLRKLDEIAEQLRSGQSVSLK

SEQ ID NO: 7761 - protein, 317 aa, Bacillus licheniformis
MADQKKIAIFGGGTGLSVLLRGLKQQPVDITAIVTVADDGGSSGRLRDELKIPPPGDVRNVLAALSDVEPLVEDLFQHRFSKGGDLIGHSLGNLILAAMTNITGDFFHAVTEMSKVLNVRGRVLPAANTSVVLHAEMDDGQIISGESTIPSYGKRIKRVFLTPEKIEPVPETIDVIRGADLIILGPGSLYTSILPNLLVPKIREEILNAPAKKVYICNVMTQPGETLYYSAADHVKALNQHMGGPFIDTILVNNEEIPDDIRERYAKEQAQPVQFNIDDLSAMGLEVIKDQIVTYENGVIRHDTHKVASLLVDLLKE

SEQ ID NO: 7762 - protein, 295 aa, Bacillus licheniformis
MNANGGHDIQLVIITGMSGAGKTVAIQSFEDLGFFCVDNLPPSLLPKFLELMKESSSKMSKVALVMDLRGREFFDSLIEALDEIGETSWITPRILFLDAKDSVLVSRYKETRRSHPLATTGLPLEGIQTERELLEELKGRSQIIYDTSDMKPKDLREKIVQHFAADHGHTFTVNVMSFGFKYGLPIDADLVFDVRFLPNPYYIDSMRPLTGKDQEVSSYVMKWNETQKFLEKLTELLSFMLPSYKREGKSQLVIAIGCTGGQHRSVTLAEYLADYFKKDYYTHVTHRDIEKKSRK

SEQ ID NO: 7763 - protein, 154 aa, Bacillus licheniformis
MQRVTNCVLTSGDKVLLLQKPRRGWWVAPGGKMESGETVRDAVIREYREETGLYVLNPQLKGIFTFIIKENDQVVSEWMMFTFVADHYTGKHVEESEEGIIRWHQAGDVGSLPMAPGDVHILDFMLKGKGLLHGTFTYTPDFELLSYRLDPQGE

SEQ ID NO: 7764 - protein, 316 aa, Bacillus licheniformis
MSEEKMYDVIIIGAGPAGMTAAVYTSRANLSTLMVERGVPGGQMANTEDVENYPGFESILGPELSNKMFEHAKKFGAEYAYGDIKEVVDEGDYKIVKAGSKEFKARAVIITAGAEYKKLGVPGEKELGGRGVSYCAVCDGAFFKNKELVVVGGGDSAVEEGVYLTRFASKVTIVHRRDKLRAQSILQARAFDNEKVDFLWNKTVKEIHEQDGKVGKVTLVDTVTGEEEEFRTDGVFIYIGMLPLSEPFKNLGITNEEGYIVTNEQMETKVEGIFAAGDIREKTLRQIVTATGDGSIAAQSVQHYIEELKEKEKAVK

SEQ ID NO: 7765 - protein, 486 aa, Bacillus licheniformis
MGKYTSEHHKDSRIVQLFQDGQYFYHKGLKAYRERNLSRASKLIQRAIFLEPENTGMLSQLAVIYTEMGFYQQSNELLDFILKNINEKMTECYYFKANNYAHLGLFQEAYKAAETYLKEDPDGEFSEENAELLDLLDMGEEDQGYSQFDQDDLILKQDRAKSLLENGQLQESIAMLEEIISDYPEFWSAYNNLALAYFYAGDVQKAKTTVFTVLEKSHGNLHALCNLLIFYHYERRDDKVEALSEQLSNIYPMLFEQRYKLGATLALVGRYDLGFKWLKSLYRMGFEGDETFYYWLACSAYYTGRVQFARSVWKKMQEEYPDDARMEPWKERKEKRPVQRPLEERLAAYYISGRKGEKAQLKAVLDSQMAKTPFEDQFVRLVLYGESGAAVDSKDALLAYRTAKAIEQADQSAMEQEAMCFWIFHVIQQIRAYGLQLKNAGGLAAAIYYIWKTEHQERLTKAETAKIFQISPGTLSKYERTLKEHL

SEQ ID NO: 7766 - protein, 159 aa, Bacillus licheniformis
MKKGGSIELTHYSEEHSAALLEFELPEEQHRFTALPKEALKRTDGQFPIVILSEGEPVGFFILHATERVKDYSDNLDAMLLTALSGDRKHQGKGFAKEGMLKLPEFVSKEFTHCHEVVLVVNVKNTAAQHLYVKAGFAGTGERKTGPIGEQIVMKLNIK

SEQ ID NO: 7767 - protein, 210 aa, Bacillus licheniformis
MIKADELTFNEAGLIPAIVQDAASKEVLTLAYMNKESFEKTLETKETWFFSRSRGELWHKGATSGNIQRVKDIRLDCDQDALIVLVEPAGPACHKGSYSCFSPGEHIRQTDGGRFDIINELETVIAKRQAEMPEGAYTTYLFREGVDKILKKVGEEAAEVIIAAKNRDPEELKWEAADLLYHLLVLLREQSLPLDDVLGVLKERHEGSES

SEQ ID NO: 7768 - protein, 252 aa, Bacillus licheniformis
MITKRIIPCLDVKDGRVVKGVQFVELKDAGDPVELAEVYDHEGADELVFLDISASHEGRKTMVDVVERVAAKLAIPFTVGGGINRLDDMKTILRAGADKVSVNTAAVLRPELITEGADFFGSQCIVVAIDAKYDPEADLYYVYTHGGRKKTNLEAVSWAKEAVRRGAGEILLTSMDSDGEKNGFDCRLTKLVSEAVSVPVIASGGAGRADHMYDAFAEGRADAALAASIFHYKETSVKEVKAYLKERGVNVR

SEQ ID NO: 7769 - protein, 245 aa, Bacillus licheniformis
MSEFTVYPAIDIRNGKCVRLIQGDYEKETIYGHSPLEMASRFAEEGASWIHLVDLDGAREGKKVNGGHVISIADKLDVKVQVGGGIRTEKDVYDYLSQGVERVILGSSAVSNTEFVKKMLKAYGGHIAIGLDARDGFVSTEGWLETSSVRAEELGRELANEGAEVFIFTDIATDGMLSGPNINSTVELARATGKQVIASGGVSSLADLEALASRASEGVSGAIVGKALYTNQFTVAEALERVAAK

SEQ ID NO: 7770 - protein, 212 aa, Bacillus licheniformis
MIGVIDYGMGNLYSVSKALERIDAPYFVSEHPDELKRADSYILPGVGAFRDAMEILTENGLKTFIQAAANEGKPLLGICLGMQLLFEESEEHGASEGLGLLKGKVVKLKDCDQAGNRLKVPHMGWNLLKVHRDSPLLPKAKEGFAYFVHSYYVSGIEEEALLASAEYGVCVPAVVGLGNVYGAQFHPEKSSTVGMLILERFKQFTQEQKVKK

SEQ ID NO: 7771 - protein, 194 aa, Bacillus licheniformis
MRKAERARKTNETDIKLSFHIDGEGKADIQTDVPFMTHMLDLFTKHGQFDLSIEAKGDVEIDDHHTTEDIGICLGQALLEALGDKQGIKRYGSSMVPMDEALAQVAIDLSNRPHLEFRAEFPSRKIGTFDTELVHEFLWKFALEARMNLHVIVHYGTNTHHMIEAIFKALGRALDEAALIDPRVKGIPSTKGML

SEQ ID NO: 7772 - protein, 426 aa, Bacillus licheniformis
MKIKSISGNTSVSLKRSIDAGTEEQRKAVRGIIEEVKKNGNAAVSAFTRQFDGADVAGFRVSEEEIKEAYSALEERDLEIIQAAIFNIKEYHERQLATSWFYHRKDGTMLGQKITPLDSAGVYVPGGTAAYPSSVLMNVIPALVAGVDRIVLASPPGKDGKLSAGVLAAAAELGVTEIYKMGGAQAIAALAYGTETITPVDKITGPGNIYVALAKREVFGQVDIDMIAGPSEIAILADSTANYREIAADLLSQAEHDAMASSILVTDSETLAESVLKEVYRQLEHLPRKEIARQSIDNYGLIYVTETMNEAVSVINELAPEHLEILTVQPDALLGQIKHAGAIFLGRYSSEPVGDYFAGPNHVLPTNGTARFSSPLNVTDFQKRSSIISYSREAFRANAEKIAAFARLEGLEAHARAIESRNREED

SEQ ID NO: 7773 - protein, 213 aa, Bacillus licheniformis
MGKELTIAMPKGRIFEEAADMLRKAGYQLPEEFDDSRKLIIQVPEENLRFILAKPMDVTTYVEHGVADVGIAGKDVLLEEERDVYEVLDLNISKCRLAVAGLPETAADTVAPRVATKYPNVASSYFREQGEQVEIIKLNGSIELAPLIGLAGRIVDIVSTGQTLRENGLVETEKICDITSRLIVNPVSYRMKDAVIDEMASRLSLIVEGEKAK

SEQ ID NO: 7774 - protein, 389 aa, Bacillus licheniformis
MFEKPHGMRDTLPMLHETKKKVRSSLTEVMALWGYQFMETPALEFNDTGGAQSATLDQQTVKLLDQEGQTLVLRPDMTAPIARVAASKLHKDDHPLRVGYAANVFRAQEREGGRPAEFEQVGVELIGDGSTSADAEVIALVIFSLKNAGLTSFKISIGHVGILDALFVEVLGNEERAHVLRRYLYEKNYVGYREHVKSLNLSSIDKSRLLELLELRGGIETCSRAASIVDSEKGKRAVLELETLWETLGDYGCTDDIKLDLGMVSHMSYYTGVLFEIYAENVGFPIGNGGRYDQLLGRFDSPAPATGFGIRTDRLLEALKPAEEQEKIDVVIFSTEQRKEAIRFAEEERRKGKKVVMQDLAGIGDIDQMTKSFQNVTYFIGARKEEKHG

SEQ ID NO: 7775 - protein, 244 aa, Bacillus licheniformis
MKFFKTLFFIFFVAVLMTAVLILFSKDALSPLAEMLHSSHKTAADNANNKGERQPLDVPLINQMDPPKLYNGCEVASLAMILNYSGYSVTKTELANEVKRVPLQYENGLKGNPNDGFVGDMENGPGLSVYHGPIYDLAHSYAGNKAVDLTGSEPGKIYEQLNQGRPVWVITTVHFTPVNDMETWNTPSGKVDVTYSVHSVAVTGYDEDYVYVNDPYGYKNRKTDRENFEKSWKQMGSQAIVIAA

SEQ ID NO: 7776 - protein, 221 aa, Bacillus licheniformis
MKRLAGTVILSGLLVCGFGQALPEKALAAEVVHKTIVVEKGQTYDGKGKRLIAGPELGDGSQREDQKPIFKVEDGATLKNVVLGAPAADGVHTYGNASINNVVWEDVGEDALTVKSEGSVTINGGSARLAADKIFQINKASTFTVKNFTADQGGKFIRQLGGSTFKAVVNIDNCTITNMKEAIFRTDSSTSSVTMTNTRYSKVGQKWIGVKHATERNNHEF

SEQ ID NO: 7777 - protein, 172 aa, Bacillus licheniformis
MRKTKRYPVSGANSLWHIYQTVPFFKVVKNFIVIQAARYTPILGMKNWMYRTFLRMKIGEKCSFALMVMPDIMFPEKISVGRNTVIGYNTTILAHEYLIKEYRLGEVIIGDEVMIGANTTILPGVEIGDGAVISAGTLVHKDVPPGAFVGGNPMRLIYTKEEMEKRLETPAE

SEQ ID NO: 7778 - protein, 215 aa, Bacillus licheniformis
MKVNTVLFDLDGTLINTNELIIASFLHTLDHYAPGRYKREDVLAFIGPSLYETFSSIQKDKAEEMITMYRTFNHQMHDELVTEYETVYETLERLAEEGYKLGIVTTKLRDTVIMGLKLTGLDAFFETVVTLDDVERPKPDPEPVLLALSKLGSRPEEAIMIGDNYHDILAGKNAGTKTAGVAWTIKGEESLAKHEPDFMLQQMSDLLHILGVEKV

SEQ ID NO: 7779 - protein, 315 aa, Bacillus licheniformis
MKGTLKAGAVAGLKTTWTLGKVIFPVTLIVSLLQHTPVMDWLIKLITPAMGIFGLSGEAAIPLVLGNMLNLYAGIAGILTLDLTVKEVFILAVMLSFCHNLIIESTVASRVGIKIWLILLVRIGLAVFSAIIINLVWHGGQDAAKYGLISAKSAAPSGWFDIALEAVTKAGLGVLQLAAIVIPLMIIIQYMRDLGWLNAFSKWFAPITRMLGMKENTSMTMVAGLTIGLAYGAGVMIKAVEEDGVSKRDVTLAFIFLVACHAVVEDTLVFIPLGIPVWPLLLIRLATAVLLTIAISRFWRKPGYSVRRKEALYES

SEQ ID NO: 7780 - protein, 270 aa, Bacillus licheniformis
MNETIEPLNPIAFQLGPIAVHWYGIIIGLGALLGLWLAVREGERRGLHKDTFVDLVLFAIPIAILCARAYYVIFQWGYYSEHPDQIIQIWNGGLAIHGGLIGAVLTGIIYAKVKGLSFWKLADIAAPSILLGQAIGRWGNFMNQEAHGEAVSRAFLENLHLPDFIINQMYIDGQYYQPTFLYESLWSFTGVVVLLLLRKANLKRGELFLIYVIWYSMGRYFIEGLRTDSLMLTENLRIAQVISIVLILCAAALIAYRRFKGREIKRYQEM

SEQ ID NO: 7781 - protein, 310 aa, Bacillus licheniformis
MPKVRTKDVMDKFKLELISGEEGINRPITMSDLSRPGLEMAGYFTYYPKERVQLLGKTEITFFEKLPEEEKKQRMLSLCTEITPAIILSRDLPIPPELVEASEENGVPVLRSPLKTTRLTSRLTNFLESQLAPTTAIHGVLVDVYGVGVLIIGKSGVGKSETALELVKRGHRLVADDCVEIRQEDQDTLIGSAPELIEHLLEIRGLGIINVMTLFGAGAVRSFKRITLVMSLELWEQGKQYDRLGLEEETMKIIDTDVPKLTIPVRPGRNLAVIIEVAAMNFRLKRMGLNAAEQFTHKLADVIEDGELEE

SEQ ID NO: 7782 - protein, 159 aa, Bacillus licheniformis
MKYNIHDTTVLNEDILTPEEKETWVLYMKVLTAAGLGDVSEWMKLDLSMPQMKVLMLLNNHGTLKVSEIAEKMGASLSNMTGLLSRLEQANFIKRTHSEQDRRTIVVELTEDAKGIFRSLYKKGHEKLKRALQKLNEQEKNKVNEGLTILEKALKADDE

SEQ ID NO: 7783 - protein, 519 aa, Bacillus licheniformis
MNQKWAVLLFTIGVFMAALDNGIISAALTTINDSFQVSPSWGAWGITLYTLGLAVSVPIVGKLSDRYGRKKLFIIEVLLFGAGSLLVALSQNFPMFLLARLIQSLGGGGIFIIGSSHILTALPKEKQGTALGLLGAMNGIAAVLGPNIGSFILDMTGSWHWLFLINLPIAAALIILSVPLMKETKGGTRKPLDLAGTVILSLAILAVMYGITNINGQRLSAVLSDPKVYFFLLIGCALFAGLIFYEKRVELKGGDPILAYSLLKNKVFQWTLFIGFLSGGLLAAVIFIPAYAEQYLHVAPEKAGYWMTPLALASGIGAGLGGMLADRKGPVKAARLSGVISFAGFLLLSSWVTEKWEFVLASIIAGVGFGFLLGAPLNMLVSEAAKQDYGTALGTLSLVRQMGMTLAPALYAGYITAGYENIGTHIKHKLNDAGITLKGFAGGETDVSRLSESLSQISDPKVKDIISEAIHESVGAGFFNLYFTAAVLSLAVIASVSVLSLYRKKQTDTASRLKKDVTN

SEQ ID NO: 7784 - protein, 1329 aa, Bacillus licheniformis
MKKYRNRQTLLLLAAVLLFALQIPISSASGEEHIQPGSPVIRHTPVEQVQKGDDIYFSAQAAADTVILYYKQHDELPYRAIPMEVEPGRQNAYIAKLESESIASGKVQYYIEAQVGDSSVKTDVYTVALKGMRTDTQKLPELLITEMVVDTSNTGGKDGYEFIEVYNNTNKAVHLNSYKIKYRHPEKGKESDVIWPFEHDDVAIPSGQTHVFWVKNRSNGHLTESDFNRYYGVHLREGKTLTALKGGGMENTAPREVIICTNSGEEVASARYQSEPDKTDVAKNKALLYRYPLDGTKHMKIISAGEEKPSPGSLLKTQAPSQTVTVMPDREKPEIHDMTDHQAVKPGETIQLLADMKDNRQVKQAQFFYRMNDDERFTEVRVEKSRNDGLYRHNIYFAELIGKEKVEYYMRAGDGSNVSSTEKKTIPLEQRILKGLRLNVSEGGTVSGKMLLKATSEKPPSETTIRIDGIEQKEGEPALEKKAYFAFDVNQTNLYFKNAVTIGRRVQKVFDDSRRRYATITVPVSPDEFKKGKPFSIKVRSGTKSTPFEQTAEENRDDFVLKNPRLILADGTIIRDERYDDPKAELPAGDGPGAHEWYEFRFTIPEAKFASLASQWHTRAWNEGQHIVEAENGEERLIRRVTVDNTGPEIKTSLKDGRTYKGSFEINAAAHDKWSGMKSIKAFLDGKKIALPYLVSSARLDAGKHELKIKAEDSAGNLSIVKKAFYIKEEKPDKPARVKNTPGSTHAKLAVRVKDPTKDKMKVSFHQGFQYTVKDEEHVDVSANESGTEPPQSFAVRGEKALTKEERSGMSALDGKGFETSSTTKFPYHRFDVKVDENTGPNDKVEVLWRGSSLPGRKVSMFAWNWASKRWETLAFHVAKDGKPFTLKGSIKAADYIRQSKASIIIQDQIQLSQNDYTFVWMSDTQYYSESYPHIFERQVKWIAEQKDKLNIQYVFHTGDLVDEADQPLQWKRADQFMKVLDDNQVPYGVLAGNHDVSHKDRSYLKFGRYFGERRFKQKPHYGGSYQNNKGHYDLISSGGNDYIMVSMGWGIGKKELQWIDDVLKRHPDRKAILAFHEFLLVSGSRSPIGEKIFEQIIKRNPNVIAVLSGHYHSSNLKVDKLDDNGDGKPDRKVYQMLADYQGGPEGGQGYLRILHVDPKHDTIHVKTYSPYLDDYNFYDPHQFGPKDEFNIKTDLKPRKKKVKTDYFELNVFSNKEIGKAKTVKSGKTASVTWKDLQPNTTYFWYAAASDQYGGNSRSQMWRLTTKDDGMKSFLIDQTAGAGSALRQLSGSPPPAGMILKKGTNLPIAEISLWLAAVFLCERKKHLFS

SEQ ID NO: 7785 - protein, 119 aa, Bacillus licheniformis
MMRWIINVLVNALLLIVIAGYFDAVHVRSIGAAITASLILSILNMFVKPVLVILTLPVTVITLGLFLFIINAITLYMTASIMGDSFDLDGFGTAIFASIVLSVFHLLIQKAIIEPMSRK

SEQ ID NO: 7786 - protein, 66 aa, Bacillus licheniformis
MKRLFRSETDRKIAGVVGGLAEYLNMDASLLRIITVLLFIFSTGVPVLLIYIVWVFLVPNEGDVNR

SEQ ID NO: 7787 - protein, 364 aa, Bacillus licheniformis
MKHEKERILKLVEEGKLSAKEALILIEKLEEDYKETESKVTALSEDVIDSEDFYSEKKKEPKPSIGSKLFEWIDTAVKKVKEADLDLNFGHSYDVQHIFQFKDTDFSTLDIQLANGSVNLVPWSDSDIRVECQAKVYRAENQDEARQAFLQHIDCGVEGDKFMIRTEKKTMKTNLTVYIPDKEYGKIRFKLFNGPVRGEHLNVKELSAKTTNGVLSFSALTAGKASLETANGQIKLADHTCGEIEAETINGLIDLKGSCEALDLQSFNGNIAATVKNPHCRTAYVKTTTGSVELNVPRDCAVTAELKSNLGSLSHDLSDAEILKEKNETIQKEMYLKANQNHDHSMTVFLESKTGSIHLNHTQE

SEQ ID NO: 7788 - protein, 108 aa, Bacillus licheniformis
MTRNNALISSICYFSVFFAPLILPIAAYFITDDQETKKHAMRSLISHIIPFISVVILAAGAISGTLIFGDGGYLAVIFMIGGFVFFGIISLIIVVWNVVQGIKMLTQA

SEQ ID NO: 7789 - protein, 76 aa, Bacillus licheniformis
MKQKSEVYASSASQLLSLIQEQKRMNQEIVNRLESINSAPPLSSEIRYLKVLLNSSSTHILNSMSEATKHISRTER

SEQ ID NO: 7790 - protein, 90 aa, Bacillus licheniformis
MSRRQLFQWPNDPRQALFKKIFIALLFNSCYNVKKQTIKGDGVMKIDRMDHLVLTVKDIDATCDFYSRVPGLNAVTFREGRKARHSAGKK

SEQ ID NO: 7791 - protein, 957 aa, Bacillus licheniformis
MATKRIEVKGARAHNLKNIDVSIPRDQLVVLTGLSGSGKSSLAFDTIYAEGQRRYVESLSAYARQFLGQMDKPDVDAIEGLSPAISIDQKTTSRNPRSTVGTVTEIYDYLRLLFARIGKPVCPVHGIEITSQTIEQMTDRILDYPERTKIQVLAPIVSGRKGSHVKVLEQIRKQGYVRVRIDGEMNDLSEDIELEKNKKHSIEVVVDRIVIKEGVTARLTDSLETALRLGEGRVIIDVIGQEELLFSEHHACPHCGFSIGELEPRMFSFNSPFGACPSCDGLGSKLEVDVELVIPNDELSLKENAIAPWEPQSSQYYPKLLEAVCSHYGIDMDIPVRDLPKHHLEKILYGSGGEQIYFRYENDFGQVRENYIEFEGVIRNIERRYKETSSDYVRELMEKYMANQPCPSCKGYRLKKESLAVLINGLHIGKITEMSVANALQFFRELDLSEKDMKIANLILREIEERLGFLNNVGLDYLTLSRAAGTLSGGEAQRIRLATQIGSRLTGVLYILDEPSIGLHQRDNDRLIETLKNMRDIGNTLIVVEHDEDTMLAADYLIDIGPGAGVHGGEVISAGTPEEVMNDDQSLTGQYLSGKKFIPLPAERRKPDNRFIEVKGAKENNLKNVSVKFPLGVFTAVTGVSGSGKSTLVNEILHKTLAQKLHRAKTKPGEYKEIKGIEHLDKVIDIDQSPIGRTPRSNPATYTGVFDDIRDVFAQTNEAKVRGYKKGRFSFNVKGGRCEACKGDGIIKIEMHFLPDVYVPCEVCHGKRYNRETLQVTYKGKNISDVLEMTVENAVQFFENIPKIKRKLQTLYDVGLGYITLGQPATTLSGGEAQRVKLASELHRRSTGRSLYILDEPTTGLHVDDIARLLAVLQRLVDNGDTVLVIEHNLDIIKAADYLIDLGPEGGDGGGMIVAAGPPEEVVKVEGSYTGRYLKPIIERDKNRMKKRLQEKEAVRP

SEQ ID NO: 7792 - protein, 661 aa, Bacillus licheniformis
MKDRFELVSNYQPQGDQPKAIDQLVKGINEGRKHQTLLGATGTGKTFTMSNVIKEVNKPTLVIAHNKTLAGQLYSEFKEFFPNNAVEYFVSYYDYYQPEAYVPQTDTFIEKDASINDEIDKLRHSATSALFERKDVIIVASVSCIYGLGSPEEYREMVLSLRTEMEIERNELLRKLVDIQYARNDIDFQRGTFRVRGDVVEIFPASRDEHCVRVEFFGDEIERIREVDALTGEILGEREHVAIFPASHFVTREEKMKKAIINIEEELEERLKALREEGKLLEAQRLEQRTRYDLEMMREMGFCSGIENYSRHLTLRPAGSTPYTLLDYFPDDFLMVIDESHVTIPQIRGMYNGDQARKQVLVDHGFRLPSALDNRPLRFEEFEKHIHNIVYVSATPGPYELEHTPEMVEQIIRPTGLLDPIIEVRPIEGQIDDLIGEIQQRIERNERVLVTTLTKKMSEDLTDYLKEIGIKVTYLHSEIKTLERIEIIRDLRLGKHDVLVGINLLREGLDIPEVSLVAILDADKEGFLRSERSLIQTIGRAARNAEGRVIMYADKITNSMEIAINETKRRREQQEAYNEKHGITPKTINKKIRDVIRATHAAEDQEEYQVKEEPKLSKMTKKEREKVIAQMESDMKEAAKALDFERAAELRDLLLELKSEG

SEQ ID NO: 7793 - protein, 77 aa, Bacillus licheniformis
MFTKAVFALIFPFILVLFFTRVTYNHYVGIALTAALLFASYLKGYTETFFIVGLDIASLVAGSLYAAKKAGEKKEDS

SEQ ID NO: 7794 - protein, 97 aa, Bacillus licheniformis
MKRAFLAGAFVCLIAVLVSAAAGDWTLIFKVSGAAGLGAILLSALCSGVFVSGDRFRGNHDAETKEHGEWNSKLANALAIFAMPNLLAAGISFFFAF

SEQ ID NO: 7795 - protein, 403 aa, Bacillus licheniformis
MSVEESLIELLKGAGLFFLHPLFYFMMIMSLAYGYARIKRERKTFHTRIEDIYDEFKFTYSKGLLAGLVLSIVSFGLGLYLPMGMLVLIAAVSVAAALTFRQSLLSAAYTLGVSIVVGLCIEYTGFGALDAFLPQLSLANWSAAAVLLGLLLVAEGVLVYKTAHIKTSPAIVMSTRGLPIGQQIAGRTWLLPLFILIPGHAIESSVPWWPVLSFNGGFELLWIPYFIGFGQRVQGSLPIESIKITAKRISVLGIIILLIAAGSIWWTPLAALAAGAAIAGRAFLSWKQRMNDNSAPFHFSKRDQGLMVLGIIPNTPAADLGLKIGEIITKVNGIEVKNAADFYEALQKNRAFFKLEVVGLNNEIRFEQRASYEGEHHELGIIFVKEEDAVMKHAEAAASAETE

SEQ ID NO: 7796 - protein, 117 aa, Bacillus licheniformis
MKRASIVREKKYYELVEQLKVRSQDVTFSATKAVGLLMLFSRYLVNYTSVESVEDINEDCAELYFNYLMDNHKRLGINLTDIKRSMQLIGDILDVEVNHYLKDFSLSNVTLWMSQEK

SEQ ID NO: 7797 - protein, 479 aa, Bacillus licheniformis
MNQKIVRLIIALSLLCGLVTGAGPIPLHDVVSKASAAEEAAAKSTARNELEKIEKAYDLISNEYVEQVDREKLLEGAIQGMLSTLNDPYSVYMDKQTAKRFSDSLDSSFEGIGAEIGMEDRKIIIVSPFKQSPAEKAGLKPNDEIISIDGDSMSGMDLNDAVLKIRGKKGSTVTLKVHRPGMKDQLTFTIKRDEIPLETVFASIKKVQDKPVGYIAISSFSEHTAKDFTAELKKLEKKGIKGLVLDVRGNPGGYLQSVEDILKHFVTKDHPYIQIAERNGNKKQYFSKLKEKKPYPVSVITDKGSASASEILAGALKEAEGYDVVGDPSFGKGTVQQAVPMGDGSNIKLTLYKWLTPKGNWIHKQGIQPTVPVTQPAYFSAGPLQLKEPLKPDMNNNEIKRAQFLLKGLGFVPGREDGYYNESTKKAVMAFQAANKLKQTGIIDQKTANTMNLRIEEKKMDEKNDLQLQAALKVLFNKK

SEQ ID NO: 7798 - protein, 369 aa, Bacillus licheniformis
MKVTTVDSRQFEIGDDPMKVFNIASIPGDGVGKEVVPAAQRVLKAVSDVHGGLSFRFTEFPYSCEYYLEHGEMMPDDGLEQLKEFDSIFLGAVGNSKLVPDHISLWGLLIKIRREFEQVINIRPAKYLQGIKSPLANPKDFDLLVVRENSEGEYSSIGGRIFRDEDEIAIQNAVFSRKGAERAMRFAFELAAKRKKHVTSATKSNGIVYSMPFWDEVFENTAKDYPDITADSQHIDALSAFFVTRPEKLDVIVASNLFGDILTDIGAAIMGSIGVAPAANINVNGKYPSMFEPVHGSAPDIIGKGIANPIGQIWTAKMMLDHFGEEELGARLLDVIEDVLKSGYLTPDIGGSSTTDDVTEEIIKRVRTI

SEQ ID NO: 7799 - protein, 416 aa, Bacillus licheniformis
MKRKLMTLGLTAVLGSSAVLIPLKSNHALAYEDLEKKKSDVQSKKSENESKLEKTKQELSELESKEASLRSEIEKIDRKMTDTNEKLEKKNEEIDKTKKSIEELKKQIKKLKEKIEKRNKILKDRVRSMQENGGSVQYIDVLLGSKSFGDFISRAGAVSTIVEADKDLMEEQKRDLQLVEEKETKLSKDLESLEKALKDLEDLKKTLDKQQKEKANVMKKVKQDKDHAHEELGSLENEAEILKRQDEAIKAEEAHRKKQEAEASRQASSGQSEASSSKPSAPSSSGFIRPASGTFTSGFGKRSLGNHFGVDIAKRGSGVPIYAAAAGTVYNAHYSSSYGNVVFITHNINGQTYQTVYAHMSSIKVQTGQRVEQGQVIGTMGNTGQSYGQHLHFEIHKGLWNNAKSNAVDPANYIPL

SEQ ID NO: 7800 - protein, 296 aa, Bacillus licheniformis
MIRTLGRHLRESLKSLGRNAWMTFASISAVTVTLILVGVFMVIMLNVYNMTLKAEQEVEVKVLVDLTANQDQKNTLEKEIKKIPEISSVKYSSKDEELKNLKDSFGEDGKFFAMFEQENPLNDAFVVKTKDPQDTPKAAKKLEKLTNVYKVTYGQEQVDRLFKISNVAKVIGIALVIGLLFTAMFLISNTIKITIFARRKEIEIMKLVGATNWFIRWPFFIEGLLLGVCGSIIPIAILLGTYHHAVQWIAPKVQGTFIQLLPYNPFVFQISAILVLIGAVIGVWGSLMSIRKFLKV

SEQ ID NO: 7801 - protein, 228 aa, Bacillus licheniformis
MIEIKDVYKTYSNGVSALNGISISIYPGEFVYVVGPSGAGKSTFIKMIYREEKPSKGKIVINNKNLAQLKEKEIPFIRRKIGVVFQDFKLLPKLTVFENVAFALEVIGERPEVIRKKVLEVLDLVQLKHKARQFPDQLSGGEQQRVSIARSIVNDPDVVIADEPTGNLDPETSWEIMKTLEEINNRGTTVVMATHNKEIVNTMKKRVIAIEDGVIVRDEARGEYGSYD

SEQ ID NO: 7802 - protein, 108 aa, Bacillus licheniformis
MKMKLFTLFMAVSFVLAACGGNNNESKEKNTGGQATATDGEEIYQQNCTGCHGKDLAGGSAPSLKEVGGKYKESEIKDIVVNGRGGMPGNLVDEKEAEAVAKWLSEKK

SEQ ID NO: 7803 - protein, 284 aa, Bacillus licheniformis
MNMDKTRYQLFTVLRDYGYILFGSAVVAVTFNMFLLPNRIAAGGVSGISTILQSFGFEAAYVQWAFNIPLFIAGVLVLGGKFGIKTLVGSVFLPFVVYVTRDIAPATENPLLAAIFGGVGIGVGIGMVFLGRGSTGGTALAAQIIHKYTGLSQGKCLALIDGTIVLSAMFVFNIEQGLYAMLGVYISSKTIDVIQVGLNRSKMAMIITNREEEVRHAVLNKIDRGITKISAVGGYTDDERPILMCVVGQTEFTKLKQLVKHIDESAFVIAMDASEVLGEGFKRA

SEQ ID NO: 7804 - protein, 327 aa, Bacillus licheniformis
MADPDFWGDQQKAQTIINEANALKDYVNTYKSLSESHEELQMTHDLLKEDPDQDLQNELVNELKSLTKQFNEFELQLLLSEPYDKNNAILELHPGAGGTESQDWGSMLLRMYTRWAERRGFKVETLDYLPGDEAGIKSVTLLIKGHNAYGYLKAEKGVHRLVRISPFDSSGRRHTSFVSCDVMPEFNEEIDIEIRTEDIKVDTYRASGAGGQHVNTTDSAVRITHLPTGVIVTCQTERSQIKNRERAMKMLKSKLYQRRIEEQQAQLDEIRGEQKEIGWGSQIRSYVFHPYSLVKDHRTNTEMGNVQAVMDGDIDSFIDAYLRSKLS

SEQ ID NO: 7805 - protein, 841 aa, Bacillus licheniformis
MLGILNKVFDPTKRTLSRYEKKANEIDALKADIEKLSDEALKQKTIEFKERLEKGETVDDLLVEAFAVVREASRRVTGMFPFKVQLMGGVALHEGNIAEMKTGEGKTLTSTMPVYLNALSGKGVHVVTVNEYLASRDAEEMGKIFEFLGLTVGLNLNSLSKDEKREAYAADITYSTNNELGFDYLRDNMVLYKEQMVQRPLHFAVIDEVDSILIDEARTPLIISGQAAKSTKLYVQANAFVRTLKADQDYTYDVKTKGVQLTEEGMTKAEKAFGIENLFDVRHVALNHHIAQALKAHAAMHKDVDYVVEDGQVVIVDSFTGRLMKGRRYSDGLHQAIEAKEGLEIQNESMTLATITFQNYFRMYEKLAGMTGTAKTEEEEFRNIYNMQVVTIPTNKPIARDDRPDLIYRTMEGKFKAVAEDVAQRYMVGQPVLVGTVAVETSELISRLLKNKGIPHQVLNAKNHEREAQIIEDAGQKGAVTIATNMAGRGTDIKLGEGVKELGGLAVIGTERHESRRIDNQLRGRSGRQGDPGITQFYLSMEDELMKRFGAERTMAMLDRFGMDDSTPIQSKMVSRAVESSQKRVEGNNFDARKQLLQYDDVLRQQREVIYKQRFEVIDSDNLRSIVENMIKASLERAVASYTPKEDLPEEWNLDGLVELVNANFLDEGGVEKSDIFGKEPEEITELIYDRIKTKYDEKEERYGSEQMREFEKVIVLREVDTKWMDHIDAMDQLRQGIHLRAYAQTNPLREYQMEGFAMFENMIAAIEDDVAKFVMKAEIENNLEREEVIQGQTTAHQPKEGDEEKQAKKKPVRKAVDIGRNDPCYCGSGKKYKNCCGRTE

SEQ ID NO: 7806 - protein, 187 aa, Bacillus licheniformis
MMEFNVRGENIEVTPALREHVEKKIGKLERYFENNVDAIVHVNLKFYNDQESKVEVTIPMTDLSLRAEVHHEDMYNAIDLATNKLERQIRKHKTKVNRKFREKGSSKHVFAEGNGIGTAVQEDIEDEQPQVVRQKRFNLKPMDNEEAILQMNMLGHSFFVFTNAETNLTNVVYRRNDGKYGLIEPNE

SEQ ID NO: 7807 - protein, 125 aa, Bacillus licheniformis
MTSTDDYMLLTTYYQLLFTIEEGFCYLIEANQDLAKTEGERIFNDLIYAFFQLDSSHAVLLSILETSCAKSSIRFFDRVFREFDSLIYYNYPSAEFQHDLIHHFLPLYREWMKTIHQCMKPYVIH

SEQ ID NO: 7808 - protein, 113 aa, Bacillus licheniformis
MEKIELLYSETKHMLAQIKGAPESDELVQAIEDFLKKRDGLIREIKPPLSETEKRQLQQVTDMEPLIMAELKRLQQAVKQELLQAKQKRAMHHSYINPYANMTIDGTYYDKRK

SEQ ID NO: 7809 - protein, 133 aa, Bacillus licheniformis
MALNNPYAAYQQNSINMATPGELTLMLFDGCLKFMKLAKQAIEQEDMETKNTNLVKAQNIIQELNITLDRKVELAASMGAMYEYIHRRLIEANINNDKDIVAEVEGYVKDLRDAWKQALQIERQGRFGSGGLA

SEQ ID NO: 7810 - protein, 493 aa, Bacillus licheniformis
MAIRISGLASGMDIDDIVSKLMKTERVPLDKLTQKKQTLEWQRDSYREINTKIKDLQESINLMLRPSTYGAKKVTSSDESAVTATGTTNAASGTIQVNKLATAATYKSSSLSGYTGSDQTLTFQVTAPGETTAKKVEISVSSTDTLDDIVSKVNKSNLGVTAMKEKIYNGSEYVETIAFTSKATGAGGSIQAADDATASFMSNQLGFALDADNKLTASQAGQNAEVVINGLQIEKTTNNFTVNNVTYQLKNTTNSPVSLDVATDVDGIYEKIKDFVTQYNELIDMVNGKLTEKKYRDYTPLTEEQKKDMTEKQIELWEEKAKSGLLRGDTILSGATNQMRTDFYSNVSVNGESLQLTQFGITTSSVYSQRGHLEINEEKLKAKIKEDPDSVANLFMAGTSSTENYNEKGIMRRLQTVLTDTKKQIEDKAGNSAMANNQFTIGKNLNTVESDISSMNNRLTQIENRYYTKFTAMEKAIQKMNEQSTYLAQLLGQ

SEQ ID NO: 7811 - protein, 113 aa, Bacillus licheniformis
MSINRLSSLEPIIDAYKTQMLNKQYEAVERPQQTDAAEFTFAQLEKTIQGANNLLEPSQVHLQFVLHEKLGEYYVKVVDNRTEEVVREIPPKEWLDFYAAMAEFMGLIVDKTT

SEQ ID NO: 7812 - protein, 310 aa, Bacillus licheniformis
MRINHNIAALNTLNRLSANNGASQKNMEKLSSGLRINRAGDDAAGLAISEKMRGQIRGLEMASKNAQDGISLIQTAEGALTETHSILQRVRELVVQAGNTGTQQTEDLTAIQDEIKALKDEIDGISERTEFNGKKLLDGTFKAPADPANPAAGEKSLVFQIGANATQQISVNIEKMSTDALGVKDPADTTGRTLVTNQSVKDIDVTKFADNAATATDVGFDTQLKIVDSAINQVSAQRAKLGAVQNRLEHTINNLGASSENLTAAESRIRDVDMAKEMSEFTKNNILSQASQAMLAQANQQPQNVLQLLR

SEQ ID NO: 7813 - protein, 74 aa, Bacillus licheniformis
MLVLSRKLNEAIQIGDDIEVKIISVDGDQVKIGIDAPKHIEIHRKEIYLAIQEENSRAASISNDLLAKLSSQKK

SEQ ID NO: 7814 - protein, 143 aa, Bacillus licheniformis
MIIKTKYHGETQIQEDQTIVFKNGLPGFTGEKKFVILPLSEDSPFVVLQSVQSEELAFIVASPFVFFKDYGFDLDETTVELLEIESAEDVEVMAILTIEEPFEKSTANLMAPIVVNRRKMLAKQVILHDSSYLTKQPIGGEAC

SEQ ID NO: 7815 - protein, 188 aa, Bacillus licheniformis
MEMPRLIMQNIPGRIGLTTTPPDLKMEQPRADLKIEQPPAELKITTTPSKLTIDQTKAWEDLERKHIFKRIEEGAQQGYQDWLAGMARTAEEGDEMMRIEIEGNPLADQARRNSEPEPIQIGVHFTPSFDRVKIAYEPAKVNIEATPRKPIIEATPNKPVVNYTPGSVKVDMLQYPEVKIDVEYPKQK

SEQ ID NO: 7816 - protein, 303 aa, Bacillus licheniformis
MRVTQGMIAKNSLRYINSSYGKLDKLQSQISSGKKITKASDDPVVAMKSLKYNTQLSQVKQYQSNASQAFTWLENTETNITEGIDIMAKIRELTVKAQNSTNGKDELNAIGVEIGQLKDQLIQIANTQVNGRYLFNGTNSDVAPITKNADGTYTYNFENYTSSSDVLINVSPNATLNVNSNPISAFGGQSSSGQNVFEMIESLENALKAGTMEGMENALSDIDQFSNQMSNERSDIGARYNRLELINARLSEQEETATKVLSDNEDVELEEIITEFITQQSVHRAALAVNAKIVQPTLVDFLR

SEQ ID NO: 7817 - protein, 507 aa, Bacillus licheniformis
MTNPTFLGLEIAKRGLSAQQSALSVTANNISNANTEGYSRQRVTFKASTPYPSVSRDSVGLAGQMGTGVEIGSVERVRDSFLDYQYRTQNTKAGYYNAKVDAFNQMEGIMNELNDTGLNKVLNSFWNSIQELTNNAHEPSAASVVAQKGQAVADTFNTLYESLTTVQSNLGDQIDQNVMTINSLLSQLNSLNEQIAKVEPNGYLPNDLYDKRDQLLDELSSMVNIKVSYAKTGGNPLATAEGIVSIEVLDVNGQSLGKVLDGPNFTTETVKVNYDNDTGLVTGVSLGGTDIGIDSFTSKGSLLGLIESYGYMSNGEEKGLYPEMLADLDTMALAFAKEFNAVHQSGFTSSGEPGGIFFEFTGGEAEPAKGAAGKIKVADEIMNSKGDKVAASLNGEASDNANATNLANVFTKKIQIGDKTTTVLDYYAGIIGEMGVKAQETNRLAKNTETLVNTAELNRQSVSAVSLDEEMSNMIQFQHAYNAAARMITLQDEVLDKIINGMGVVGR

SEQ ID NO: 7818 - protein, 158 aa, Bacillus licheniformis
MKRVIEELERLCVLHEHLLSLSEQKTEALKTNEIKALSEIVTKEQKYVQAIEQTEQSRIEATKSCIGSSDATISACISKAAGGEKKVLEQLYAKLSQLVTRLKDVNDLNKQLTFQSLQFISLTFDMLLPNEGGSNYGKEQQPNQTGGVKRLSLFDSKA

SEQ ID NO: 7819 - protein, 88 aa, Bacillus licheniformis
MKINQYGTQPVNPYHKSFEKQTASSQGAAQPEDKVEISAKAKELQKGPDLMKERQEKIAQLKAAVENGTYKVDGKGIAEKMVNFYKQQ

SEQ ID NO: 7820 - protein, 139 aa, Bacillus licheniformis
MSQLANCPRCNALFMKSSFQTVCASCLKEEERAYEIVYKFLKKQENRQSTMFQIVEKTGVEEELILKFIRQKRIQISNFPNLGYPCERCGTLIREGRYCMSCEQDLASQMSQLDQLEQLERERNNSSKGTYYTFKPKND

SEQ ID NO: 7821 - protein, 244 aa, Bacillus licheniformis
MKTRFAQAIEEGGNKLNCLICAAPLLHSLSWHSFFFLRSEEKICRECKENFIEIKGTVCPKCGRPQGSEELCGDCAKWEANPLTRSLLRQNRSVYLYNTFMKEVLARFKFRGDAELVFAFAPSFISAFQQYFRRSPSVLVPIPLSEERKAERGFNQAERLASLLQIPVIHPLIRIENEKQSKKSRKERIKPKTVFRTEKGSVKNLDVILIDDLYTTGATLHHAADCLMTSGEAKSVSSYTLIRS

SEQ ID NO: 7822 - protein, 94 aa, Bacillus licheniformis
MLVNAKEAVLEELFDQYIDQLHMSCTCSRCREDVLALALNAVKPQYVTDQSKLAYIKAELVDKQKNTSMLVTLAEAARKVNENPLCASNRRGRE

SEQ ID NO: 7823 - protein, 466 aa, Bacillus licheniformis
MEVIHIEQPAFYTRELRSCLEQRHLLKSELPFRESVVDWHIQEGLIKTEEGIKKTKKGFICLRCGQHERSFFARYPCYRCSKCCVYCRSCVMMGRVSDCTPLLTWHMHVSHKWAPVHTEWKGALSAGQEKAAKSIINAIRRKEELLVWAVCGSGKTELLFQGIEFALNNGLTVCIATPRTDVVLELAPRFRQAFPGVEIAALYGGSSDVGNLSPLIISTTHQLLRYKEAFDVIIIDEVDAFPYSIDNTLQYAVKKSAKRQSAHIYLTATPSADMKKRAESGKLDTVRIPARFHRSPLPEPTLIWCGNWKKSLKRRKVPFRLKKWLFKHQELQQPVFLFVPSVPVLKSVVSVLKKETFRAEGVYADDPDRNEKVNRFRESKLEVLVTTTILERGVTVKKAQVGVLGAESAVFTESALVQMAGRAGRHPEHTDGDVCFFHYGRTKSMNAARRHIQNMNKMSKKEMLID

SEQ ID NO: 7824 - protein, 280 aa, Bacillus licheniformis
MKTAVVTDSTAYIPKDLRDRYNIHMIPLNVIFGETSYREEIDMSWKDYYKEVKAHENLPTTSQPAYGELISLYEKLGETYDAVISIHLSSGISGTFNSAVSASGMLEGIKVYPFDSEISCMAQGFYAIEAAEMAEKGAAPEEIIRHLDHMKTSMRAYFMVDDLSHLQRGGRLSGAQAFVGSLLKVKPILHFENKLIVPYEKIRTRKKAMNRLFELFGEDAEKGKPLRAVVIHANREEEADQIIEELSKQYAHVEFYKSYFGPVIGTHLGEGAMGIAWYTV

SEQ ID NO: 7825 - protein, 229 aa, Bacillus licheniformis
MTKVNIVIIDDHQLFREGVKRILDFEPTFEVVAEGDDGDEAARIVEHYHPDVVIMDINMPNVNGVEATKQLVDLYPESKVIILSIHDDENYVTHALKTGARGYLLKEMDADTLIEAVKVVAEGGSYLHPKVTHNLVNEFRRLATSGVSSHAQHEVYPEIRRPLHILTRRECEVLQMLADGKSNRGIGESLFISEKTVKNHVSNILQKMNVNDRTQAVVVAIKNGWVEMR

SEQ ID NO: 7826 - protein, 385 aa, Bacillus licheniformis
MSVSKMDSKVLDSIIMKMLKTVDGSKDEVFQIGEQSRQQYEGLVEELKQIKQQVNEVIDLGDRLEVHARHARNRLSEVSRNFHKFSEEEIREAYEKAHKLQVELTMIQQREKQLREKRDDLERRLLGLQEIIERSEGLVSQITVVLNYLNQDLRQVGVLLEDAQAKQDFGLRIIEAQEEERKRVSREIHDGPAQMLANVMMRSELIERIFRDKGTEEGFQEIKNLRQNVRNALYEVRRIIYDLRPMALDDLGLIPTLRKYLNTIEDYHGKAKIHFQCIGESEERRIAPRFEVALFRLAQEAVTNALKHSESTEIHVKVEVTKDFVTLIIKDNGNGFDLKEVKGKKNKSFGLLGMKERVDLLEGSMTIDSKIGLGTFILIKVPLSL

SEQ ID NO: 7827 - protein, 212 aa, Bacillus licheniformis
MLQSYLTVAGEGTHEIVIEKSRFICHLSRVSTEEEAQNFINHIKKQHWNATHNCSAYVIGENDQIQKANDDGEPSGTAGVPMLEVLKKRNLKDTCAVVTRYFGGIKLGAGGLIRAYGKSVSEGLNHVGVVELKLMRVMHTTVNYTWIGKLENELRESPYQIKDVHYADDVEFETYVKESEKQAFTEWITELTNGKSENREGIQVYLEEAFNN

SEQ ID NO: 7828 - protein, 358 aa, Bacillus licheniformis
MAERIKVKVRKKKNKKRRLIKRFIVLMLLALLAVGGVGIYKIINTISAADGTYDELERGEKSKLRDDVVDIQKKPFSILFMGVEDYSTNGEHGRTDSLIVVTLDPKKKSMKMLSIPRDTRVHLASDTTGTKTKINAAYAKGGKDETIETVEDFLGIPIDYYATVDFDGFKDVIDEIGGIDVDVPFDFSEKSDVSKSKRIYFKKGNMHLNGEEALAYARMRKQDKRGDFGRNDRQKQILKAALDQISKPQNLAKIDTIAQKASKNIQTNFRITQALALQQIYSGFAGDDIKTLNITGQDLTIANVYYFEPDQQNLENVQNELTHHLYPDSAADSSGTSSESSATADGADSSAESSAASY

SEQ ID NO: 7829 - protein, 124 aa, Bacillus licheniformis
MDDHYLGQIEQIVKALYKSWSSDSSSKWSKDNPAKGQCGVTALVVNDILGGEIKKTKLPEGWHFYNFVNGKRYDLTVSQFKEDILYMDIPSNRDEAFSDTSEKQYNYLKHSMINHLPCSNSKLR

SEQ ID NO: 7830 - protein, 354 aa, Bacillus licheniformis
MSYERTVIAFFVSLITVLIITPLVKRLAIKSGVVDQPDKRKIHDKVMPRMGGLAIFIGVLTGSFAGGLYENRITAITLGAFMIVILGIVDDKYNLSARIKFIVQVLVACIIVSTGLKMEFLSIPFWDLRFDLGWLAYPLTILWIVGITNAINLIDGLDGLAAGISVIGLSTIAVMAFSADKILIFSLSLVVIGSTVGFLFYNFHPAKIFMGDTGSLFLGYVISVLSLLGLYKSVTLFSVVIPIIILGVPIFDTTFAIIRRILNKQPISAPDKSHIHHRLMAFGLSHRKAVIVIYLIGVVFSLSAILLKTATLWVSIFIIFGLILFMQIIAEVTGLVNEQYKPFTKFYRRMVKRN

SEQ ID NO: 7831 - protein, 393 aa, Bacillus licheniformis
MKADQFIHVIVATGEWGQDQLRYRRHRLAEFLAGRKETKEVIWVCPSENPSRETFTLLDNGIKQFAVKDFLKKKIFRFARYKDVFYQSKLKPLLDRLKEDVQGEKVCLWYTFPGFPLLSSLYQWDQVIYDCSDLWAAPISGSQSLVSGFRQKVIFEAEGRIIKAADTIFCTSEYLQQNVADRLQGETKPVFTIENGVEYSLFAENMQKADVLKGREGTVLGFIGGIKPKLDFKLVKEAARTKKEWTFLFVGPDGTNGDEDFKALLEEDNVIWTGPAAPSEVPAYMNVVDIGIMPYKPSPYNNAVFPLKLFEFLAAGKPVAGMNLPSTEKVEQEHVYRHLTGNDPAEFTAVCEELELAHDDVSHVELRRKIARERDWHHLFLMMLDKLNLNKDA

SEQ ID NO: 7832 - protein, 252 aa, Bacillus licheniformis
MTRQKPLISVITPSYNAEEFIEKTIKSVLNQTFSDWEMIIADDCSTDGTRDILKRYEEDDERIHAIFLKENQGAAAARNAALSKAEGRYVAFLDSDDVWKAEKLDKQLAFMRKHQHAFSFTAYELISQDGEPLHKTIHAPVSLTYDDVLKNTIIGCLTVMIDREQTGDIRMPNIRTRQDLATWLSVLKRGFKAYGLNEPLAEYRIVETSISRNKWKAARKTWYVYREIERLHLMKATWCFFHYAKNAVMKRL

SEQ ID NO: 7833 - protein, 224 aa, Bacillus licheniformis
MNLIKRIAGRVKKFIVAIIALPLILGLVGYFMPKGSVAPSNYTATVTISTGNYGEAKYNNAKQVPLLLKNEAFLKDIFPDMPEEDLAQLKDDLAIEIRTDSLFNLSYTGPDKQETLDTLGKIKDAYMKGDKALFSKREEVIEKNIKALEDETVSADSKVDKQRFLYELETSKLDMKAAEEIEPLIVLDNQAAGMSPKKRAVLGVLIGLALSFFIIVIPEVFRER

SEQ ID NO: 7834 - protein, 484 aa, Bacillus licheniformis
MSLKRSAVNVLVWLAALTAGLAFVVLAQSNAKKILLACLILIALAVIVVLRKYLSSEQLLMPVLYLLIAATFANNAFFAIKLGFFSLFPYRILLILAGFLFIAEMLKGSQHLEKWKQVHVKGILMFFAFWFCYGLISLLWVKSATDGIKYLFLLAMGMFLVFLVVMFFQKMDRILAFYYIWLVMTVFLMVIGFYNHFTLNHLPSSTLYNGPHYKQHYPTSVFFNQNDFATFLSISFFFYLSFFKNIKNSYLKIAGLLLAFCSAYLIFLTGSRASILGVIAGLAVYVFILLPKVLKKWALIAAAAGCIAFVTLFAGKITGAFYTYFLAPQTAHDFSEPLPSNVARANLLKNAGHYVLDTYGFGVGAGNVPYYLEHHALFDTDRVVEVHNWLVEIMTNFGVVMMLGYLTMYIYLITVLYRYYKRSLGRRPKLLIEGLTAALVAFLVSSISPSSVSNLYFHWVFLALVIATVNTFRVCGTDETEQYR

SEQ ID NO: 7835 - protein, 309 aa, Bacillus licheniformis
MEKVLVTGGCGFIGSHIAEQLLKENYRVSILDNLTTGHRSNIDGLPIDFYEQDITKPEVIDVIKSIDPDYIVHLAAQVSVAESVSDFLNDENINIRGSLHIIKAAGECNVKKIVFASSAAVYGNPDYLPVDTRHQTNPGSPYGLTKLTVENYLKLAYDLYGTEYCILRYSNVYGPRQDAKGEGGVVSIFSDLLTSGKAPVIFGDGEQSRDFIYVGDVACANVKALKAQSNVCLNVSNGFSITVNELFTEMKKATNSELSPIYQDERPGDIRHSTLCNEETKKILNWEPKMPLAEGLEKTISYYKKEMNT

SEQ ID NO: 7836 - protein, 444 aa, Bacillus licheniformis
MLKRIAVIGTGYVGLVSGTCFAEVGNSVVCCDIDAEKIRGLSAGVMPIYENGLKELVDKNVNENRLFFSTDIPKAIEEAEIIYIAVGTPMSETGEADLTFVKSVAEMIGKHLNGYKVIVNKSTVPVGTGKLVQAIIERNSKGEFPFDVVSNPEFLREGTAIYDTMNMERAVIGATSEKAAAIIEELHKPFQTKIVKSNLESAEMIKYAANAFLATKISFINDIANICERVGADVSKVSEGVGLDSRIGSKFLKAGIGFGGSCFPKDTMALLQIAKSVGYPFKLIEAVIETNQKQRAHIVQKLLDVFGDLNGMTISVLGLAFKPNTNDMRSAPSLDVIPMLRSLGAKVKAFDPIAVPEAEKLLGDQAVYSEDLYETIQDTDACVILTEWPEVQNMDIAKLKSALKNPVLIDGRNIFEIEQMRNEGMIYHSIGRPEVQGEGILTNV

SEQ ID NO: 7837 - protein, 392 aa, Bacillus licheniformis
MKVLWITSVYPSSQRPGEGVFHETQVQALQMQGVDVTVICPLPVNPAPLRLLKKKYRQVRTVPEYEERKGIPVYRPPYTALPGQLKWAQPHRRIAKSVLRTIEKHGLAPDLIHAHFAMPSGGAAAVVSQKLKVPYVLTLHGSDVNIYPHYSKGAFRAFETAVHSAAKVLAVSEALKAKTKEMTGAESSVLPIGVNLDRFQKPSASTLELREKLGLPQDKKLLTFVGRLVKGKGVAELAEAVRQLDDSYRAVFIGDGPEKQNIRQIAGEKAVLTGQVANHEISEYLAASDLFVLPSYSEGMPTVVIEALALKVPVLCTAVGGVPSLFGKHEHLLIKPHSASSITEAVKGYLEGGNWQEAIAEELYQTVHEDYDAFKNAGKLLDVYGDVVKNKN

SEQ ID NO: 7838 - protein, 479 aa, Bacillus licheniformis
MSTITKQILSGAKWTSVSTLIVTVIQIIQFALLGNIMTIAEFGLVGMLTTVTIFTQIVLDMGFGAALIQKENISERQLSTLYWLNILTGILLFIGLFFLSPFIADFYQRDELVFLVRILAVMFLIAPVGQQYQYMLQKDLKFNVLSKIEAGVTVLSFVLLLVLVFLMDPIVAYALSQVFLNSVKGIMFFAVYLKKWRPSFVFALGEVKEFFSFGAFQLASRLVNRLGANIDMILIGRFLGAEALGIYNLAYQIITIPVLKINPIVTRVAFPVFSKNQGDNQTLREGFLNMTKLLALISFPLLIGLTTVSDLFVEVVFGEKWLQAVPVLNILAIVGLLRVLMNPNGSVLLAKGRADLAFYWDSGIMLLYGLSLYAAVLTNDLTITAWTYAAISLVNFFIGRWLLKYVIQLKLGEYFRTVGKPLALTLLMALLALVLSVGSRHLLHGAMLQLAVSVGISGIFYGFLVGKFYRRAMRAQLGR

SEQ ID NO: 7839 - protein, 219 aa, Bacillus licheniformis
MSIDKSLRMYNEYSSQQTYSCALSKKAVRYLYMKRIMDIVLSLIGLALTLPFILLFCILICIETPGSPLYRQERVGKDGKHFKVIKLRSMRIDAEKSGAKWAQKDDPRITAVGSFIRRTRIDELPQLINVLAGDMSIVGPRPERPMFTAQFHHEIPGFKNRLIVKPGLTGLAQVNGGYDISPREKLVHDLYYIRNLTFLLDLKVMLKTIKVVLTGEGAR

SEQ ID NO: 7840 - protein, 484 aa, Bacillus licheniformis
MLGFFLFVPNVFAANSVTRLDGANRYEVAVNVSKQGWTSASTVIVANGKAYADVLSATPFAYRNNAPVLLTEASKLPTATKNRISQLKPSKVIVIGGTVSVQNGVVSEIKKLGVSSVERIGGANRYEVAANIANKLPSNSKAVIANGTAYADSLAIGAYAARNGIPILLTSSNSIPTATKNAMKSKGTTSTIVVGGEVSISSSVYKQLASPTRIGGSNRYEVAANVVKKYYSSAKNAIISNGYAYADGLTGSVLAAKQNRPMMFTNASSLPTPTREVIGSKNMTTFTVLGGTVSLQSNVVSQLKNPIVGKKIFIDAGHGGTDSGAVGNGLYEKSVNLDVAKLINTKLSNGGALPIMARTNDTYLTLAQRVSKAQSNHADLFVSIHANSATPAASGTETYYYTTYESANSKRLATEIQNRLYVALNTKNRGVKIGNFHVIRESKMPSCLVELAFISNVSDATKLKSSTYKEKGAKAIYDGIVAYY

SEQ ID NO: 7841 - protein, 714 aa, Bacillus licheniformis
MKKMKLLLLSSVTAAALMFTQSAQAADKTISVKLSNYLGNKSSVDVDITGAYEIPGSGIAATERYGGATRFDVANNVASAGWTNPSTVVVVNRDAFADALSATPLAKKYDAPILLTDAGTLTAKTETQIAKMKPDNILIIGGTTSVSKNVENTLKKYGAIDRIGGANRYDVSKNIASRMGSYSQAIVATGLVFSDALSIAPYAAMNGYPILLSGNNTIRSDYNIPSKVTIVGGPLSVSTGVENTLKKKAAVTRIGGANRYEVSANIVNTLNMNASKVFMSNGTTFADALAGSVLAAKQKHPLLLVQAGSLPTPVADVVAKKGTQSFALLGGTTSITDSLKNSLADMFTGDGYSVNVSSGKLVLYKNNRAVKTLGTSFTASPKKYSTSNSISINGRPYLGKMKFTIESSKYVRPINENIPFEDYLKGVVPHEMPASWQTEALKAQAVAARTYSVGSAGKVVADTQAFQVYGGYDWNSKTSSVVNATKGQVLKYNGNLISAVYSSSNGGYTEASAEVWGGSVPYLIAKADTYDPQNSWSISLNRTQINTSGLNLSSPGTWWNTTNETNSAYLSGLKSWFITNKYPSAESIKITKISSLTLSSAKTAGQRPKTAEVKFSYFVKEKSNGYVLSNGKLSEKTATISVTTTQLRSMLGGMNMKSTYASVSSNTNAFTLSGKGFGHGIGMSQYGANARAAAGHDYKKILSFYYPNTTLSSY

SEQ ID NO: 7842 - protein, 106 aa, Bacillus licheniformis
MKKLIVLTLSMLLLLSACGTSGQSEDKSSSDNKNAASEETVTKEGSFAGLADSHTIAVNIDGKETTLQVDEDLQDKVNSIEEGKKVEVQYTKGENGVLELKSIETK

SEQ ID NO: 7843 - protein, 306 aa, Bacillus licheniformis
MRAEKRKKKKKILYTIIALIGIFVLSTGSYAYYLWHKAASTVANIHENINKSKKRDSAVDIDNHDPFSVLLMGVDERDGDKGRADSLIYMTVNPKTKTTEMVSIPRDTYTEIIGKGKMDKINHSYAFGGVQMTVDTVENFLDVPVDYFIKVNMESFKDVVDTLGGITVNSTFAFNYDGYSFGKGEITLNGKEALAYTRMRKEDPNGDFGRQNRQRQVIEGIINKGANISSITKFGDMFKVIENNVKTNLTFDDMWDIQSGYKEARSKVIQHELKGDGTKINGIYYYKADESSLSDITAELKESLNK

SEQ ID NO: 7844 - protein, 380 aa, Bacillus licheniformis
MKKLKVMTVFGTRPEAIKMAPLVLELRKYPEIESYVTVTAQHRQMLDQVLEAFNIKPDFDLNIMKERQTLAEITSNALVKLDELFQSIKPDIVLVHGDTTTTFAGSLAAYYHQISVGHVEAGLRTGNKYSPFPEELNRQLTGSIADLHFAPTEQAEQNLLRENKDPETIFITGNTAIDALRTTVRDGYSHPVLEKIGNDKMILLTAHRRENLGKPMENMFKAIRRIVEEFDGVQVVYPVHLNPAVREAAAKHFGDLNKVHLIEPLEVIDFHNFAAEAHFILTDSGGVQEEAPSLGKPVLVLRDTTERPEGVQAGTLKLAGTDEDKIYQLTKQLLTDQDEYRKMSRASNPYGDGQASRRIAEALLYRYGYRSARPDVFKDK

SEQ ID NO: 7845 - protein, 292 aa, Bacillus licheniformis
MKKVRKAIIPAAGLGTRFLPATKAMPKEMLPIVDKPTIQYIIEEAVEAGIEDIIIVTGKSKRAIEDHFDFSPELERNLEEKGKIELLEKVKKASNLADIHYIRQKEPKGLGHAVWCARNFIGDEPFAVLLGDDIVQAEKPGLRQLMDEYEKTLSSVIGVQQVPEDQTHRYGIIDPLTNEGRLYQVKNFVEKPKPGTAPSNLAILGRYVFTPEIFMYLDKQQIGAGGEIQLTDAIQKLNEIQRVFAYDFEGKRYDVGEKLGFIQTTLEFAMQDDELKDSLIPFMQDLLAKEEV

SEQ ID NO: 7846 - protein, 303 aa, Bacillus licheniformis
MKLKVSFRNVSKQYQLYEKQSDKIKGLFFPNKDKGFFAVRNVSFDVYEGETIGFVGINGSGKSTMSNLLAKIIPPTSGEIEMNGQPSLIAISAGLNNALTGRDSIRLKCLMMGLTNKEIDEMYDSIVEFAEIGEFINQPVKSYSSGMKSRLGFAISVHIDPDILIIDEALSVGDQTFYDKCVDRITEFKNQGKTIFFVSHSIGQIEKICDRVAWIDNGELRMFDDTKTVVKEYKEFISWFKKLSKKEKDKYKKEQLASRKQVLSEEDLAHLEKDKNKQKSLANIIPIAGLSILVVLAAGAMFV

SEQ ID NO: 7847 - protein, 275 aa, Bacillus licheniformis
MNALVKILKEQVTSFPLILRLAAYETKSKYQMNYLGVLWQFLNPLIQMLAYWFVFGIGIRKSSEMITGVGEVPFIIWMLAGLIPWFFISPTILDGSNSVYKRINMVAKMNFPISSLPSVAIAANLFSYFVMMAIYVIVLLAFGIYPNLQWLEYIYYLFCMIVFMFAFSLFNSTISVLVRDYQFLLQSVTRLLFFLLPIFWDISTQLGDKHPALLNVIKLNPLFYIIDGFRNSFFDGSWFFEDITYTLYFWAFTLLLLTVGSVLHMKFRDRFVDFL

SEQ ID NO: 7848 - protein, 1205 aa, Bacillus licheniformis
MNKKVLKRKIKFIKDPIENYLKKRNHRRNNKYAKFYKKLNVVDNTILYESRDGKSITDSPFAIFDYLIKNPEFNHYKHIWTIADFEALEPVISKYKDMPNVEFVKRNSDKYLQYLATAKYLINNSTLQSFFICKEEQVYINTWHGTPLKSMGFDIPGNPAHSQNVLRNFISADYLLSPNKHTTNMFLNSYKLEGLYSGEIIEEGYPRIDLTLNTSPEEFKSYLKDLSLLISNDKQTILYAPTWKGNSVSKVKNDVFQIISDMNYLEEKIGSDYNVLIKVHPFLYSEASKVSELKGKLIPDFIDTNQLLSTVDILITDYSSIFFDFLVTDRPILFYMWDADDYNKQRGKYINNEDLPGPVLYNVRELVEAIGNIHQVKSEFQTNYEKNKVKFTNHDDGNVTKRVVEKIFKNKGQLNVIRDLDKKKEKILIYPGGMKNNGITSSFLNLMNNIDFDKYDVSCFMKTPHSREVLNNINKVNKNVRFIFKPGLPVYTLFDVYKDKLVHNRGANGKLEKKLYPEDAYLREHKRLFGKSKFDYVIDFSGYSLYWAKYLVCADAKKKICYMHNDLLSDSERLVNGRRPHKINLRGLFSIYNKFDKLVSVSKGTMELNKKNLAIYADEDKFDYIMNSINPEKILGIDHLKEKDTEKLAIAEQNHEEIIANKSFKARAKIVNVEGFFIINSLFDKVNQKLTPAKEFENKEVTIIREAHTNDGKVFYKFTIDDSIIGWLNLEAFELLPDSILLERKVNKLAVIQHPNGNDIWNKPYKTLDVQKVSSSKQYKGIIVEVDKEVRTQHSFYSRIYINDILIGWIDNSALKIVKEYQSHPEDTEKQSAIKNEKAKIKRKNYKKHSKIIQGLENRTLEEIKMNLFATITNGENYTIWTKAYPNNGCKEISTAEEFNDTIVIVKKSHKTKEGEYYRFYADGKAIGWLDSRAFNIIEEPVIARSREVKYNAIVNLSDADFIYNKPFDLPGCTPIEDYQKFNEQEVEIVEEALTQEGTYCKAVLNNKVLGWIGRKSLNVIEPPGIKVGKTLVPYPSECNYNFVNMGRLSPEKGQDNLIKAFHTHIQSYPDSRLYILGDGPLRKDLQKIVDSLELQDYVYLMGQLENPFGFMKMCDCFVLSSHYEGQPMVLLEAMTLGMRILATDIIANRTVLENGRYGTLVDDSIAGLENGLKAVRTEINTVMQAFDYNEYNKKAMDTFYKVLN

SEQ ID NO: 7849 - protein, 711 aa, Bacillus licheniformis
MDSAIPIEFQLREIKINDARLYFVFESSISLNHVGILAVNRNSKKEMRVTCNKISDSGQLKAAEISLNNLSNLIIDETVIDFYVLYENNEKNQCKKRIYTASKPIELYWHQDRVKQFIYLPYTTRKGHFALDVSRRKAVAEPDSIKLSSEGKLMIRGYTFLLDAEECSIIKSRKLVLKEISQNDKERVFNFPLKGVQRVDLSADSSDHAVGFEAEIDLKKLYEENRMPAFFKFYIEYVGEDAATGEEIAIKSRAFKLIDDIESFSIVNTKKGPARFHIYPQKRKRGMRLRMNDYTIKTRAVYFAKGKGKRLMSVIRKGKNKAKKKISGMVKRAYYFTFGLAGKLPVKKKTVIFESFAGKQYSCNPRAIYEYMKEHHPEYNLIWSVNPSYTEIFEEKNVPYIHRFTLKWLFAMARAEYWVVNSRLPLWIPKPKHTTYVQTWHGTPLKRLAVDMEEVHMPGTNTEKYKQNFTKEASKWDYLISPNRYSTEIFARAFQFNKTMIESGYPRNDFLYTDNRPETMKAIKRKMNIPEDKKVILYAPTWRDDQFYKKGKYKFDLDLNLEKLREEIGDNYVIVLRMHYLVAENFDLSPYKGFAYDFSSYEDIRELYMVSDLLITDYSSVFFDFANLKRPMIFFVPDIETYRDKLRGFYFDFEQEAPGPLVKTTEEVIEKIKETETSDYRLPDIFEPFYEKFCYLETGNSTEKVVKTVFK

SEQ ID NO: 7850 - protein, 135 aa, Bacillus licheniformis
MKKVITYGTFDLLHWGHIKLLERAKQLGDYLVVAISTDEFNLQKQKKAYHSYEHRKLILETIRYVDEVIPEKNWDQKVQDVIDHDIDVFVMGDDWEGKFDFLKDTARLFTFREPKGFPRRRSKRKSRTFNVGSVK

SEQ ID NO: 7851 - protein, 260 aa, Bacillus licheniformis
MLQTETVHHLAYVNGDLPGFLNHLEKSFIDRNEGAFIATVNPEIGYAAAKDKDYFKTVSSADFIQPDGIGIVLTSRLINSRLKSRIAGYDVFINLLSLADRKKKRVFLYGAKQEVIQAVADRLSTEYPGIELAGYSHGYVKDKGEVAKQIAAAKPDMVFVALGYPHQEKFIYEHKHLFPQAIAIGIGGSFDVFSGKVKRAPKMFIKLNLEWMYRLLTNPTRWKRMLNIPKYVFSVLKEERVQKQRHYYPEQIKEQSKIDL

SEQ ID NO: 7852 - protein, 387 aa, Bacillus licheniformis
MNIRSLLVMVYSAGLALTGFIFRLVKARDRAVLLVSFPDNARALLDEYVSSSRPFEMEVLYTRHAVSLADEYPSVRSQVINEKNPIHLIKAVYRMFRCKFVLTDNYFLLTSVLNKRPQTTCIQIWHASGALKKFGLEDIGNRYRSAGDIKRFKKVYRSFDHIVVGSEKMADIFKRSFGLGDDRFLRTGVPLTDEYFHAGRQTAERPDQKVILYAPTYRDYCLTSVRLPFSKEQLSGELQGEFLLLVKLHPAVREQIAFEEHEGLIKDVSDVPLKDLLMESDILISDYSSVAFEYALLNKPILFFTYDMAEYNEKRGLIDDFEAVIPGKACMDSEMLLKEIKEMSDTKEEIKKFAEEWHQYSTGDASMRLLNFMSEHMTANEKRPAGS

SEQ ID NO: 7853 - protein, 876 aa, Bacillus licheniformis
MKNIRKTVIFAAIILLVHTAVPAIPALAAYTDTSVYKIETAKEFNSESEALKAAEQLKKDTGWKAEVKPSGKNGTTYVLTSEGVEGESRAKNLLLQFEKETGLKASYGPIGKKEPFSKAVSKEFAGEEKAKEWALQFEKETGLKATYTLAGNREAYVKVATGGIEGEDNTKAILDRFQKATGLKASYAPYGAGQAIVKLYSAEIADESKAKSLLVQFEKETALKGTIETVKKQQPKYKIATSSIQGETNAKNLLKQFEKELKVKGAYEAAGQPAQLYNVKSGYFNDEKSAKNAAGQIKKKTGLASSTEKVKGTRFWIVSMKSVDSQNLKKIDAFFKKKTWRYTAAKAGKKQTSFRIVSVPLSDQKKANDGIRFFKNKNIQASAQSTGSTTVSRFRIASAETAVQARINKGLEFFKKNGAAGTAGSTGKKVYSHYQLTTESVYEQNKVTQALNFFKETGIHAEAVKTGQYYSRYKLSSEALIGTEQLQQALGFFSKRNIPGKIEQTGEYGYRQYRVTTGRITSKADLDKGLNVFKKNNVSATYQTKTVSLFHISINEQFTGKDRADAAANRIKTNYGWPVNVVKVKNGPQITTTDYGITLSQMIDKQMKVSPQTDAPAYVSLSYINTANQTVTADLLNIRSSPLVTGGNIIGQLQKGDKVNIISQENGWAKIRMNWRNASRDEVEKYVNPENFTQDSSAYFQFLKLSQTAGLNAAEVNAKILYNKGVLTGKGQAFIDAARAYSINELYLISHSLLETGNGTSELAKGTMFNGKKVYNMYGVGAYDSNPLYYGAKYAYEQGWFTPEAAIMGGAKFIGEKYIHHPTYKQDTLYKMRWSPNALHQYATDVGWACKQVGRMYSLYTLLDQYTLYYDVPVYR

SEQ ID NO: 7854 - protein, 316 aa, Bacillus licheniformis
MTQSPIFLQPEFKERIWGGTALRESFGYDIPSDLTGECWAISAHPNGPNIVASGPYKGKTLAELWDEHRELFGGAEGDRFPLLTKILDANQDLSVQVHPDDYYAGEHENGELGKTECWYIIDCKEGAEIVYGHTARTRTELVTMINSGDWDNLLRRIKIKPGDFYYVPSGTIHALCEGTVVLETQQSSDTTYRVYDYDRTDQNGEKRELHLTQAINVTTVPHVDSYVDESTETQKGITIKTFVEAEYFSVYKWEIDGAAELTQDAPFLLCSVIEGEGKLTQGGELFPISKGTNFILPAETNDFTIEGTCELIVSHI

SEQ ID NO: 7855 - protein, 170 aa, Bacillus licheniformis
MEFGEKTRRKGQSEASMKVMNIIHDSIVDGEGLRTVVFLAGCPHMCEGCHNKQSWNINNGFDMSVDEVFEEIMKNPLTNVTYSGGEPLLHAGELIELSEKIKQHSEKDIWLYSGYTYEQILKNEKHSALLAYCDVLVDGPFELKKRDLTLLYRGSSNQRIIEFASSQAEA

SEQ ID NO: 7856 - protein, 622 aa, Bacillus licheniformis
MTTGFKEQGLLQLTETFHDIVGYGNHDIMQENANVDGRSPMGQMSRFASESSRHYALHYLMSPEIKKAVDDNFIYPHDLDYMPSGTTTCCQIPLVRLLKEGFHTGHGSLREPKDIMSALSLASIIFQSNQNMQHGGQSFPMFDYDLAPYVRKTYEKHLAKIKQYPTTLTEEEIRERAWEETDNTTYQACEAFIHNANSMHSRGGGQVPFVSINYGTDTSREGRLLIKNILKATKAGLGKGETPIFPIQIFKMKEGVNVDQTDPNYDLYRLALETSAERLFPNFSFIDSPVNKPFYDGTPESEIAYMGCRTRVMSNIHGKENSVGRGNLSFTSINIVKIALLSENVEQFFALLNRYMDLTIQQLLERYAFQCKKRAKDFKFLYSQGIWHESEKLEPEDTLEDVLKHGTLSIGFIGLAEALTALTGKHHGESEESFELGKKIVQSMRDKADEATEKHKLNFSLIATPAEGLSGKFVKKDKVEFGSIRNVTDRVYYTNSFHIPVHYKLTAVEKIRKEAPFHLMCNGGHISYIELDGDPKKNIKAMDMLVTAMRRSGMGYASINHPVDHCKACGFTGIIDNECPQCKNRDEALIERIRRITGYLVGDMSKWNSAKRQEEKDRVKHL

SEQ ID NO: 7857 - protein, 327 aa, Bacillus licheniformis
MKIKATIERVPGGMMIIPLFLGATLNTFAPGTAEFFGGFTGALITGTLPILGVFIFCVGATIDFRSSGYIARKGLTLLIGKVGFAALLGLIAAQFIPDEGIQSGFFAGLSVLAIVAVMNETNGGLYLALMNHMGRKEDAGAFAFISTESGPFMTMVTFGVTGLAAFPWETLAATVIPFLLGCILGNLDPELRDLFGKVVPAIIPFFAFSLGNTLDFNMLIQSGLLGIVVGVSVVILSGASLYLLDRFVARGDGVAGVAASSTAGAAVAVPYALADANPVFAPVADSATAIIATSVIVTSLLTPLATVWIEKRTKQRKSPKQMTIDYK

SEQ ID NO: 7858 - protein, 207 aa, Bacillus licheniformis
MTVMEMSMIGKVQEQLGEAGLIAVVRADGKEAAEETIHRLIDKGITAIEITYTTPGASELIEKFAGKDGLLVGAGTVVESEQAREAAAAGSKFIVSPGFSESLAEEAASLHTFFIPGVLTPSEIMEAVSKGFRVLKLFPGGTSGIPYMKNLAGPFPKVRFIPTGGIHPGDVEKWLDAGALAVGVGSQLNKVSEADLQRIFQRRAQQK

SEQ ID NO: 7859 - protein, 321 aa, Bacillus licheniformis
MSLDVMTFGESMAMFYANEAGGLHEASSFSKALAGAETNVAVGLSRLGFRVGWMSKVGADSLGTFILNELKKEGVDISEVKRTADRQTGILLKSKVESGDPDVTYYRSGSAASTMSIDDYPAEYFKQAKHMHVTGIPPALSREMRGFARHAVHQMKKDGKTISFDPNLRFQLWPDQQTMVHTINEIAAQADWFLPGINEGKLLTGCNSPEDIAKHYVMQGVKVIVIKLGKEGAYYRTSEKEGYVPGYQVEKVVDTVGAGDGFAVGMISGLLDGLPLEEAVQRANAIGALAVMAPGDMDGLPSRDQLKAFMAGEKNNQKIGG

SEQ ID NO: 7860 - protein, 338 aa, Bacillus licheniformis
MKDKQTAKVTINEVAAHAGVSKSTVSRYINGKIDAISPKKVKSIKKAIEELNYRPSQMAQGLKVKKSKVIGFLVADITNPFSVATLRGVEEVCDQYGYSIMVCNTDNSPEKEREMLHKLNAHYIEGLIINTTGRNNDVLLDLISQDVSIVLVDRKVPGLKIDAVTTNNREVTSQIVNLMYDKGYAQVGLFTEPIKGISPREERASAYTEIALERNAGGTPLVYEADVKDKESLLQSVKSFLEMKEGKKAILGNNGLLMLKIISCLYELGISIPEDVGIAGFDDTEWYKLIGPGITTIAQPSHEMGRVAMERIIKRIEGDESAPQTIQLEAELVLRQSL

SEQ ID NO: 7861 - protein, 247 aa, Bacillus licheniformis
MFVENKLNMFYSHEDRVVIGGAVPVKESIALDAGDFLKTDYFLERREIGIVNVGKPGAVKVGDEEYVLEHKDFLYIGLGNKDVFFSSLNEGGAKFYFISATAHQKYPVQKASLSELPYDHLGEEASSNVRNLYKVIHADGIQSCQLMMGITFLEPNNTWNTMPAHVHDRRMEVYLYLDLAEDAKVFHFMGEPTETRHLVVGNEQAVISPAWSVHSGSGTSNYCFIWAMAGENYTFKDMDAVPMNVIR

SEQ ID NO: 7862 - protein, 254 aa, Bacillus licheniformis
MGYLESYFSLEGKTALVTGPGTGIGKGIAEALAKAGADIIGTSHTSGLDETKRLIEEAGRTFTSYQLDMGNLDEVEAFAKEVPDRHQIDILVNNAGTIRREKAADFSRENWEAVINVNLNSLFLLTQAIGRQMIERKQGKIINIASLLSFQGGILVPAYTASKHAVAGLTKSFANEWAAYNVQVNAIAPGYIATNNTKQIRDDQNRNAEILKRIPAERWGQPDDIAGAAVFLSSPASDYVNGHVLAVDGGWLAR

SEQ ID NO: 7863 - protein, 377 aa, Bacillus licheniformis
MKAVTFQGPQHVEVSQVEDAKIEKSDDIVVRITSTAICGSDLHLYQGNFPLPKGFQLGHEPMGIVEETGPDVTKVKKGDRVVIPFTVACGHCFYCENKLESQCDNANPHYDSGGYFGYSEKFGNHPGGQAEYLKVPFGNFTPFVIPESCEMEDESLLFLSDVLPTAYWSVLHAGVKKGDTVIVLGCGPVGLMAQKFAWMEGAKRVIAVDYLDYRLKQAEALNRVEVFDFTKYPDMGEHLKEITKGGADVVIDCVGMDGKKSPLEYLEQKLKLQGGTLGPIQISTKAVRKCGTVQITGVYGSNYNMFPLGAFFSRNVTLKMGQAPVIHLMPEIYKKIEENQFDPKEIITHQLPLEEAGRAYHLFNDHEDDCIKVILKP

SEQ ID NO: 7864 - protein, 477 aa, Bacillus licheniformis
MKGKRSNAWLYFFGALGGVLYGYDTGVISGAILFMKDELGLNAFTEGLVVSAILIGAIFGSGLSGRLTDRFGRRRAIMSAAVLYCIGGLGTALAPSTEYMVAFRIVLGLAVGCSTTIVPLYLSELAPKESRGALSSLNQLMITIGILLSYLINYAFSDAGAWRWMLGLALIPSIGLLIGIFFMPESPRWLLTKGKEEKARRVLSKMRGGERVDQEVKEIKEAEKQDQGGLKELLEPWVRPALIAGVGLAFLQQFIGTNTIIYYAPKTFTNVGFEDSAAILGTVGIGTVNVLMTLVAIRFIDRIGRKPLLLFGNAGMVISLIVLSFSNLFFGNTSGAAWTTVICLGVFIVVFAVSWGPIVWVMLPELFPLHVRGIGTGVSTLMLHAGNLIVTLSFPVLMEAMGISYLFLCYAAIGIAAFLFVFFKVTETKGKVWKRSSRICGTSTAESRQLTHSRLNDRQKDGQGPILFCVKRPADHG

SEQ ID NO: 7865 - protein, 318 aa, Bacillus licheniformis
MLRSQRTKKKRLRKWVKYSLFFIALILTATAAAGGYAYYKVANASKDAQVTLSRGEQSVKRIKEFNPKKDNFSILLMGIDARPGQSMDKERSDAMVLATFNRKDKSVKLLSIPRDSYVNIPGRGYDKITHAHSLGGRDLSTETVENLLDIPVDYVMEANFSAFKEVVDELGGVPITIKEDYIVRQIKKDTKGKVNLQTGEQTLGGEEALAYVRTRKADTDLKRGERQMEVIKSIINKSKSLTSIPAYDDILDTVGKNVSMNLSLNDAIGLIPFMTSIQTVDTLQLKGSDYQPGKVYYFQLDQENLNEIKQELKQQLDV

SEQ ID NO: 7866 - protein, 286 aa, Bacillus licheniformis
MRLIAIDLDGTLLNTESKISAENRAAIKKALISDCIVTICTGRATFDVKALLNDLDIPIIAANGGTVHDFNYKLLSRTLMDKEAGKKAAQYLTDHQIYFEVYTDDALLSPYDGEQKLKAELDIVTSANPDEDRDTLWQGALTQFKQFGIKPVPDIREIFNGDEHIYKLLCFSFDMEKLKKAKDDLSAFPKLGLTSSGRHIIEILPDESGKGRALKELARHYGIEKKDIYAIGDSPNDLSMFEEAGHRIAMGNAIDELKHISTFITKSNDENGVAYFINKLLENEYQ

SEQ ID NO: 7867 - protein, 414 aa, Bacillus licheniformis
MIKKAANKKLVLFCGIAVLWMSLFLTNHNDVRADTIGEKIAETARQLEGAKYSYGGEKPKTGFDSSGFVQYVFQSLDITLPRTVKEQSTLGSSVGRQQLEKGDLVFFKNAELESDGPTHVAIYLGNDQIIHSTKSNGVVVTKLEGSSYWSSGYFKAKRITKEPEISMDPVVQKAKSYVGVPYVFGGNSPDLGFDCSGLTQYVFREVLGVYLPRSAEQQWAVGQKVKLEDIRPGDVLFFSNTYKPGISHNGIYAGGGRFIHASRSNKVTISYLSASYWQKKFTGVRRFDNMSLPKNPIVSEAIRHIGEVGYQKGGTSPKEGFDTAGFIQYVYKTAAGVELPRYADKQYSTGKKITKQELEPGDIVFFKGTTVMNPAIYIGNGQVVLVTLSAGVTTADMETSAYWKDKYAGSVRIE

SEQ ID NO: 7868 - protein, 55 aa, Bacillus licheniformis
MKFVRAIWPFVGLVLIIAFMSAFKYSDELSNDEKAKISTEIQKVNQQDQTTENKQ

SEQ ID NO: 7869 - protein, 389 aa, Bacillus licheniformis
MKKQLNFQEKLLKLTKQEKKKTNKHVFIVLPVIFCLMFVFTWVGSAKTPSQMDKKEDAKLTATFVGDIMMGRNVEKVTNLHGSESVFKNVKPYFNVSDFITGNFENPVTNAKDYQEAEKNIHLQTNQESVETLKKLNFSVLNFANNHAMDYGEDGLKDTLNKFSNENLELVGAGNNLEDAKQHVSYQNVNGVKIATLGFTDVYTKNFTAKKNRGGVLPLSPKIFIPMIAEASKKADLVLVHVHWGQEYDNEPNDRQKDLAKAIADAGADVIIGAHPHVLEPIEVYNGTVIFYSLGNFVFDQGWSRTRDSALVQYHLMNDGKGRFEVTPLNIREATPTPLGKSDFLKRKAIFRQLTKGTNLDWKEENGKLTFEVDHADKLKNNKNGVVNK

SEQ ID NO: 7870 - protein, 149 aa, Bacillus licheniformis
MFGSDLYIALILGVLLSLIFAEKTGIVPAGLVVPGYLGLVFNQPIFMLLVLFVSLLTYVIVKFGLSKIMILYGRRKFAAMLITGILLKIGFDFIYPVMPFEIAEFRGIGIIVPGLIANTIQRQGLTITLGSTLLLSGATFVIMYAYYLI

SEQ ID NO: 7871 - protein, 393 aa, Bacillus licheniformis
MWVMLLACVIVVGIGIYEKRRHQQNIDALPVRVNINGIRGKSTVTRLTTGILIEAGYKTVGKTTGTDARMIYWDTPEEKPIKRKPQGPNIGEQKEVMKETVERGANAIVSECMAVNPDYQIIFQEELLQANIGVIVNVLEDHMDVMGPTLDEIAEAFTATIPYNGHLVITDSEYTDFFKQIAKERNTKVIVADNSKITDEYLRQFEYMVFPDNASLALGVAQALGIDEETAFKGMLNAPPDPGAMRILPLMNAKNPGHFVNGFAANDAASTLNIWKRVKEIGYPTDQPIVIMNCRADRVDRTQQFAEDVLPYIEASELVLIGETTEPIVKAYEAGKIPADKLFDFEHKSTEEIMFMLKNKLEGRVIYGVGNIHGAAEPLIEKIQDYKIKQLVS

SEQ ID NO: 7872 - protein, 326 aa, Bacillus licheniformis
MATIKDVALAAKVSVATVSRVLNETGYVHEDTRARVLKAMEELNYHPNEVARSLYKRESRLIGLLLPDITNPFFPQLARGVEDEIHRLGFRLIFGNSDENLEKELDYMQTFKQNHVVGVISATNYPDAPNYQDLSMPIVFLDRTGENAPAVFADSREGGRIAAAEMIKRNAKRITLIKGPAHLQTARDRFNGALDVLSGADIDFHVMKTETFSFPEAQKRAAELFGTYPETDGVIASNDIVATAVLHEALKRKIKVPDELQIIGFDDIPQSELLFPSLSTIRQPAYEMGKEAAKLLLRLMKNEYIEQSAVQMPVAFIERQTTRKAE

SEQ ID NO: 7873 - protein, 293 aa, Bacillus licheniformis
MSKICVIGSSSMDLVVTSPKRPAAGETVLGESFKTVPGGKGANQAVAAARLGAEVHMIGCVGDDHYGKAILDNFQANGVLTDYVEPVTGQESGTAHIVLADGDNSIIVVKGANDHVTPEYVQKALPAIKQADIVLIQQEIPEETVDYVSGLCSSLGIPLLLNPAPARPLRPETVEHAAYITPNEHEASVLFQGMSREEALKRYPEKLFITEGKNGVRYHNGLEERVVPSFPVNAIDTTGAGDTFNAGFAVALSEGQSIESALRFANRAASLSVLKFGAQGGMPKRDEVERELS

SEQ ID NO: 7874 - protein, 131 aa, Bacillus licheniformis
MKKHGILNSHIAKLLADLGHTDTIVIADAGLPVPPGVPKIDLALTLGTPGFREVTKLIADEMVVEKVTAAQEIESVNPGQAAFLKAEFSNQKIDYIPHEAFKKATSQAKAVIRTGEATPYANCILHAGVIF

SEQ ID NO: 7875 - protein, 493 aa, Bacillus licheniformis
MHIKMKDIFKAFGQNQVLSGVSFELQEGEVHALMGENGAGKSTLMNLLTGLHKLDSGTIEIDGKETYFSDPKEAEQNGIAFIHQELNIWPEMTVLENLFIGRELSSKLGFLNNKKMKALAKEQLERLGVSISLEKEAGDCSVGQQQMIEIAKALMTDAKVIIMDEPTAALTEREIEKLFGVIRALKKNGVSIVYISHRMEEIFTICDRITVMRDGKTVDTKRIPDTDFHEVVKKMVGRELTERYPERQPNPGRVVLEVKQASKKGVFQNISFSVRSGEIVGISGLMGAGRTELMRAVFGLDPLDSGDIFIEGKKAALKKPSDAVQKGIGFITENRKDEGLVLDTSIRENIALPNLASFSPKGWIDKKSEQEFVDLLIKRLTIKTESPETHARNLSGGNQQKVVIAKWIGIGPKVLILDEPTRGVDVGAKREIYQLMNELTDRGVAIVMVSSELPEILGMSDRVLVIHEGTLSGELSRNDATQERIMTLATGGR

SEQ ID NO: 7876 - protein, 320 aa, Bacillus licheniformis
MKTQPAVKKSLNVDSVMQKLGPFLGLIILVVIVSLLNPSFLEPLNILNLLRQVAINALIAFGMTFVILTGGIDLSVGAILALSSALIAGMIAGGIDPVFAVIIGCLIGALLGLVNGLLITKGKMAPFIATLATMTIFRGLTMVYTDGNPITGLGNHYGFQLFGRGYFLGIPVPAITMAAAFIILWVILHKTPFGRRTYAIGGNEKAALISGIKVPRVKMMIYSLAGLLSALAGAILTSRLNSAQPTAGTSYELDAIAAVVLGGTSLAGGRGRIAGTLIGVLIIGTLNNGLNLLGVSSFFQMVVKGVVILIAVLLDRKKSA

SEQ ID NO: 7877 - protein, 304 aa, Bacillus licheniformis
MKKTLTVFTALALLFLSACSLEPPEWAKPNKEKGTDIKIGLSVSTLKNPFFVSLKNGVVKEAKKQGIEVIVVDAQDDSAKQTNDVEDLLQQGVDALLINPADSSAISTAVQSANSLGIPVVTLDRSAENGKVETLVASDNVKGGQMAADFIVEQLGKGAKVAELEGVPGASATRERGSGFHKTADDKLNVIAKQTADFDRTKGLNVMENLLQGNPDIQAVFAHNDEMALGAIEAIRSSGKEILVVGFDGNEDAVKAVQAGDMSATIAQQPELIGKLAVQAARDILNGKKVEKTIPAPLKLETKK

SEQ ID NO: 7878 - protein, 253 aa, Bacillus licheniformis
MKSASKQKIIQPVDKNLDQVYQVSTMVSLLDGIYDGDFYMSEAKEHGDFGIGTFNRLDGELIGFDGEFYRLRSDGKAYPVQGSDCSPFCSLAFFRPDIYHEIKQRMPLEAFEEEMKRIMPSENLFYAIRMDGTFKKVKTRTVELQEKPYVPMVDAVKSQPIFDFNDITGTIVGFWTPQYANGIAVSGFHLHFIDEDRNVGGHVFDYEIEECTVQISQKLNMNLRLPNTQDFFQADFNKHDLAAGIEAAEGNPE

SEQ ID NO: 7879 - protein, 572 aa, Bacillus licheniformis
MNNVAAKNETLTVRGAELVVDSLIQQGVTHVFGIPGAKIDAVFDVLKDKGPELIVCRHEQNAAFMAAAVGRLTGKPGVCLVTSGPGASNLATGLVTANTEGDPVVALAGAVKRADRLKKTHQSMDNAALFQPITKYSAEVEDANNIPEAVTNAFRAAASGQAGAAFLSFPQDVTAGPATAKPVKTMPAPKLGAASDEQISAAIAKIHNANLPVVLVGMKGGRPEAIEAVRRLLRKVKLPFVETYQAAGTLSHDLEDQYFGRIGLFRNQPGDMLLEKADVVLTVGYDPIEYDPVFWNGKGERSVIHLDEIQADIDHDYQPEIELIGDIAETLNHIEHDSLPVSIDESFAPVLDYLKKALEEQSEPPKETKTDLVHPLQIVRDLRELLSDDITVTCDIGSHAIWMSRYFRTYRPHGLLISNGMQTLGVALPWAIAATLVNPGQKVVSVSGDGGFLFSAMELETAVRLKAPIVHIVWNDSTYDMVAFQQEMKYKRTSGVDFGGIDIVKYAESFGAKGLRVNSPDELAEVLKAGLDAEGPVVIDIPVDYSDNIHLADQRFPKKFEEHFNKEASKQS

SEQ ID NO: 7880 - protein, 292 aa, Bacillus licheniformis
MELRHLRYFMVVAEELHFGKAALRLNMTQPPLSQQIKQLESEIGVTLLKRSKRAVRLTAAGGVFLKQIKEGLSQIDQAVDMAQRTARGELGRLVIGFVGSATYEIMPPIIREYRNRFPSVQIDLRELSTPNQIDALLNGHIDIGVLHPPLGNDELKSYTVKKSHCVLALPKHHPLTEKARVHLKDLEEESLIVIAKEAWPSLYTEFNFLCEKAGFIPNIAQEATEYQMVIGLVSAGMGIAVVPTAAKRLFNLDVVYKEIEDFPLRAEWITAHRKDNRNPALKHFIEISDQHS

SEQ ID NO: 7881 - protein, 527 aa, Bacillus licheniformis
MEKLKIGSKQMVVSPHYLASLAGSIIMEKGGNAFDAAVAVSACLAVVYPHMTGLGGDAFWLMYHNGSGEIKGYNGSGRSGRKADRDQYKGERAIPVRGPRSAITVPGMVDSWAEILAAYGRLSLREVLKPAIMYAEKGFPVSPDQCQNTVKNAEWLSCMPITADIYLPGGKPPSPGERFVQKELARTLTLIAEKGRDTFYKGEIAQALAAYLQNNGGILNLEDFGLHRGEWVSPLSSTYRGYAIYQMPPNSQGFTGLMTLNILENYDFGMIEHGSFEYYHLLIEALKLSFSDCNKVLTDPEFSQIPLGRLLDKEYARELAAKIGLPALQAESRPLGSDTSYAAAVDEDGNAVSFIQSLYFEFGSGVTAGDTGVILQNRGAFFSLDPDHVNTLEPGKRTFHTLMPAMAFRGGKPKFLYGTQGQGGEGQPQTQTALITRMVDYGMDPQTAVHEPRWVWGRTWGERVEGVRIESRVAPEVIAKLRKHGHHVTVVGEFDGVMGHAGIIEIDDQGFLRGGSDPRSDGAAIGI

SEQ ID NO: 7882 - protein, 158 aa, Bacillus licheniformis
MSLDYHMPNLILDETDKKILSILHEEGRISYTDLGKRVGLSRVAVQTRINNLIEEGIIEKFTAVINPVKVGIHVSVFFNVEVEPQYLEAVAVALEKEPAVTSLYHMTGPSKLHMHGIFANDQEMEEFLTKRLYPLKGVVSVDCQMLIKRYKSRMGMKL

SEQ ID NO: 7883 - protein, 189 aa, Bacillus licheniformis
MKHPYRELIIAMTRTGILGFGGGPSVIPLIRHEAVSKFKWIDDDEFGEILAIANALPGPIATKMSAYLGHKVKGVPGAVVATAAHIMPTCAAMAALFAAVNVLSHSKIVSGMIGAVTPVIAVMLGIMAYEFGQKALKGFGLLTGVLFFILAFLGLQVFSIHPGIIVILFLTFKLKRKAAREKDKGVSAS

SEQ ID NO: 7884 - protein, 178 aa, Bacillus licheniformis
MIIFYLFWAFFIANLLGYGGGPASIPLNFEEVVQHFHWLSKEEFSNMLALANALPGPIATKIAAYVGYSVLGWPGVFIALAATVLPSAIALVLLLKLIGRYRQSQVVKGMTLSVQPVIAVMMLLLTWEISGDAIHSIGMVQSLVIALISLVALTKFRVHPAFLIVAAFAYGGLVIPLL

SEQ ID NO: 7885 - protein, 250 aa, Bacillus licheniformis
MIDIHCHILAGVDDGAACMNDSLEMAKQAALQGIHTIIATPHHRNGVYEHPKEAILAAVSGLKTRMQKENIPVLITPGQEIRLYGELKRDLERGRLLSLAGTKYLLIELPYHHVPRYAEKVLFDLQLNGYIPIIAHPERNLELMENPDLLYRLVKNGACAQLTCSSLAGRFGRSVKRLARRFLEANLIHFIASDAHNLTTRSFFFDTVENDYGRDFLNVFTENAGLLLENREIHKETPRPVKKKKLLGLL

SEQ ID NO: 7886 - protein, 240 aa, Bacillus licheniformis
MRDHIGFKDVFIVLKKRFVLIALITIAAALSSAAVNFYWLKPVYQASAQILINGRQTSNFTDIQTNLELINTYNVIMKSPIILNKVKDELNLSETAEDLKQKITVISENESQIVSISATDKDYSKAADIANTVAAVFQRDIGDIMGENAEISLVAKANPDHSPVPVSPNKKFNIALFTGFGLLFGAGLAFLLELLKNTVRNEEDIEKDLNVHVLGNILYVKPKKGQARKLESFVGKDHTF

SEQ ID NO: 7887 - protein, 532 aa, Bacillus licheniformis
MLQDMISKTVVMDAAEQFKHVLPCTEENIQLMKKALILYRQDSVYRVKPMSGHTVSAYVQDVVPVKVFIDLADVKKSSCSCPAQNMCRHVLAVYLYLYAQYDRLGTFTEFWKEAQKRRENREILGQLQRGMKPRSHTLDQWTSFFNTEFRRWEEHTPKNQQTMQYLYYGYFSALKKRTPAEPELKKMYQIHAALATWLAMHSLVEKGRIDPEKDFYSLNPYIEQLMDTIYSSIDELKTYALSFSLDPFLEKTPGVIRELLLKKDIFQYERLRIFGEIWSALLSRPNWLKRELDVLNNLEPSPEIQFGRLHLEFLLKNDDVILDQAGSFSPEILPYTFQWLSVMTAKKDWKRLKKWYEHLEQLAAGFCRLDKPYREIRDVLSEFFLFLSDYSKNAKEEHVFERYCKECLPYTFTEYSHFLYNKNRFTEWMEIHSLVGFSISEIGQNALKDIAAAAPEALIPSYHREISGLVEQKNRSSYKEAVKQLKKLRTLYKKAKKQDVWNRFMEQFSARYKRLRAFQEELKKGKLIDGES

SEQ ID NO: 7888 - protein, 921 aa, Bacillus licheniformis
MASLKEIVIHVEQSEDYTFILSCHDGDHQFLTRNEMERHLFQWHESSFYGTFLEEAGLDTPAVLLSPWMAVEFLGKNSFNSFSDIILTEETEPLMKTASTIYEFIADEDFLPDYEAWKQEMLRWKDKEGILEGYTAEWFSHAVEDYINYNDELKAKWESIVAHSPAVTTFQGHFLDEDDFLETIGWHENPVPFTVGLRLNEPDFDGDDWKIELFLRDKKSGAIQFFEGLNRLKKSWQAYADKIDREQDRFRQIVPWLTIESGTSLLTEEEAWIFLSEASETLVSMGIEILLPSWWQIVRDSNMLLKAKVSSAPRGESFVGMNALMDFNWRFATNGIELTEEEFEQLVANKRRLVNIRGQWIKIDPNFIKQMKKLMERAETEGLHMSDILARELTERSETREDDDLFDASAFSDVRFELSYQLKNMIRKLSQRDDLPSYPVSKYFHGTLRAYQEDGLNWLIFLRNCGFGACLADDMGLGKTIQMIAYFAYLKEQGQQTPSLIIAPTSVLGNWQRELETFAPGLTAALHYGPKRPKGEAFQTSYKDADIVLTSYGLAQSDFDDLSSVAWNCICLDEAQNIKNAHTKQSRSIRKLKGLHHIALSGTPMENRLTELWSIYDFMNKGYLGSLGSFHKRFVLPIEKDRDEKRIEQLQQLIKPFLLRRTKQDKEVALNLPEKQEEKEFVPLSAEQASLYEQLVKDTFEHMSSLAGMQRKALILSMLGKLKQICGHPALYLKETGSELLNGRSVKLEKLLELTKTIRESDESCLIFTQYLGMGDMMKRLLEKSFGEPVKFLNGSLSKLERDKMVEQFQNKEFPILILSLKAGGTGLNLTAANHVIHYDRWWNPAVENQATDRAYRIGQKRFVHVHKLITTGTIEEKIDQMLESKQSLNDQIIQSENWITELSEHELEELFTLNASAITG

SEQ ID NO: 7889 - protein, 292 aa, Bacillus licheniformis
MKMIAVDLDGTLLNSESKISKKNIDAIKKAREHGIEVVVATGRASFDVQTIFEPTGIKTWIISANGAVIHDPEGSLYHSVPLDRKRAEGILRWLEENNYYYEVFSDEAIFTPQNGRELLDIELDRLKSANPEADLSRLELAAEQQLSQNGYAYISSYTDLFLAGKDVNVYNILAFSFHKEKLETGWRQFEDAQDITLVTSAEHNFEIEHLQASKGLALEKLSHKLGISLQETAAVGDSLNDFSMLKIAGKSFAMGNARGDIKEMADEVTLTNDENGVAHILHQLIEQQVKPV

SEQ ID NO: 7890 - protein, 256 aa, Bacillus licheniformis
MYQEERLISIIDYLKEHKRISVEQICSLFGVSRDTARRDLVKLQEQGAIIRTRGGAILPTVHDEVKDYSGRLGMVSEEKSMIGKAAASLIREGDRIILDASTTVQSCAEHLPDVNCTIITNSINLADVLSSRKGADIRLLGGKLQKEHRFLYGASVIEKLSCYHVDKALIGVVGVSEHGLTIAHEEDGMVKRKMISQAKQVIALADHSKIGRTDFYRYAELSDIDLLITDRLPSKPFQKLLDEHDVELLVAEHHDT

SEQ ID NO: 7891 - protein, 221 aa, Bacillus licheniformis
MNMLIDSAHIPEIERLLDSFPAGGVTTNPALIARENKPFKQQIQDIRRLLPEHLPLHAQVIADHWRDMVDQAKALYNWLDGNVSVKIPVTTQGLYAIRKLAAENIQTTGTTVYTAAQAVLAAKAGASYVAPYVNRIDQEYGNGAGVVKTIVGLFNTNCLNCKVLAASFKHNRQILAVMEAGSHEATISPELISRLADHPAVDRDIHAFREIWHSQYGTFSF

SEQ ID NO: 7892 - protein, 261 aa, Bacillus licheniformis
MEMNKGKVALICGGGQSLGEALSYRMAEAGYDIAVADINGENAERTADHAAGQYGVKSLWIQADFTKEADVKKMIGRVTDEFNKIDVMVYSAGIAKSNKITDFELEDWERTIEVNLTGYFLCARETSKVMIEQGSGSIIQINSKSGKVGSKHNTAYSASKFGGVGLTQSLALDLAEHNIRVNSIMPGNLLKSPMFQSLIPQYAKKLGIPESEVERVYTEKVPLGRGCTYDDIANAILFYASDQASYMTGQSINVTGGQVMH

SEQ ID NO: 7893 - protein, 123 aa, Bacillus licheniformis
MVMLYETKINRIGAQAAAFSDEKMLILFGEGAPDELKDYCLSIDIKPVEGDFNEGDELILGGETYKITAVGGAVRQNLANLGHITLKFDGSVSAELPGTLYLERKEQLPEVSAGDCIQVKRFS

SEQ ID NO: 7894 - protein, 335 aa, Bacillus licheniformis
MSSYRSVEVSKGPGGFGGPLVITPDEERNKIVYVTGGNKPDFADHLAELTGCTLVDGFKTTVPESEMAAVIIDCGGTLRCGLYPQKRIPTINVMATGKSGPLAAHITEDIYVSGVKKENIKLLGAVEEPEQSNIPEEKQIQNKQNHYSTEKKISEQQSPKGMMAKIGMAMGSIVSTFYQAGREAIETVIKTILPFMAFVALLIGIIKESGIGDIFAKYLSPFAGSLPGLLLISLVCSFPLLSPFLGPGAVIAQVVGSLIGVEIGKGNIPPNLALPALFAINSQAAADFVPVGLGLAEAEVETVEVGVPSVLYSRFLTGAPTVFIAWLASFGMYDS

SEQ ID NO: 7895 - protein, 182 aa, Bacillus licheniformis
MKNVTWLAEKFMDLFRHGGEVFVGMLTDIVPLLIMLLVAMNALIRLIGEKRVEALARKSGKNPLTRYMVLPVIGTFMLANPMTLSLGRFLPEKYKPSYYAAASYSCHTHNGLFPHVNPGELFVFLGIAAGITTLGHETTELALRYLLVGIVTNFLRGWVTDMTTAYVAKQQGIALKDSIDLK

SEQ ID NO: 7896 - protein, 147 aa, Bacillus licheniformis
MIIYFIIALGAAWLLQSVLGFWQIRHFNRTFAAYRRIGRVAVGRKTGLLRAGTVVLFVIDKRNKILKASKMQGVTVFSRIRPLKGFEGKYLLKIGQAELARHDRLTRLAIEDALRTFDIITKGGDVPQKKTRLQKLMSFQIKKRGEI

SEQ ID NO: 7897 - protein, 320 aa, Bacillus licheniformis
MEMRDDKRLLIKVCKMYYEEDMTQSQIAKATGIYRTTVGRMLKKAREAGIVKITIDDHVGTHYDLERELEQLLGLKEVYICDAKPEQTAEDKKKLVGKAGAEILKRVVKDGDTVGFAWGTTMAGMIGEFHGVKKRSASFVPLVGGPGAMDTKYHVNSIVYSIAGDFGGTPYFIDAAAVVEKKETKEEIVKSHYFKKIERLWNGLTVAAVGIGAPLSSSNMIWTGFYGDQDIERLEEKHAVGDICSRFFDRSGALVETEIHDRTIAIDINRLKDLEYSIGLAESHEKVPSIIGAAKGRYINVLVTTAETAREIAEEVRNQS

SEQ ID NO: 7898 - protein, 115 aa, Bacillus licheniformis
MFNEIMLVGRLTKDPELRYTSDGVPVANVTLAVSRPFKNAAGEVEADFVNCTLWRKTAVNTAEYCEKGSIIGLSGRIQTRQYVNSEGERTFITEVVARSVRFLGESRKAHEPADA

SEQ ID NO: 7899 - protein, 123 aa, Bacillus licheniformis
MNHFYLKEVFVIASNSAADCRQYMPMICFSAGNKKHEISTYANEGIMFRYETKDGMEIYEFQVTLKQKELSFRLYAWDGGSYVRVYSERWLSSPVFFQFLKNTYFSNKNEMIFMISGRKKQKL

SEQ ID NO: 7900 - protein, 137 aa, Bacillus licheniformis
MKTFRLIDLKIVRQDDTSKRLEEFPLIDGLIINKEDGENHWMVEGLVSKEYRYFFEYLLQEGKEVKAYVTITKKSNRPAQLLAKVKNITVLGEHVSVLLDGKMVSSKLRKGSDKILEDLMKEGYSGDRLLEAFKQNI

SEQ ID NO: 7901 - protein, 126 aa, Bacillus licheniformis
MWKEFKSFAIRGNVIDLAIGVIIGGAFGKIVTSLVNDLMMPLLGLLLGGLDFSALSFTFVDAEIKYGLFIQSIVNFFIISFSIFLFIRYISKLKKKDAEEEKAAPDPQEELLKEIRDLLKEQTNRS

SEQ ID NO: 7902 - protein, 144 aa, Bacillus licheniformis
MLDAQQIKEIIPHRYPFLLVDRVTEVEEGKRAAGYKNVTVNEEFFNGHFPDYPVMPGVLIVEALAQVGAVALLMKEENRGRLAFFAGIDSCRFKKQVKPGDQLHLELEVLRFRGSIGKGKGVAKVDGEVVCEAELMFSLGEKQE

SEQ ID NO: 7903 - protein, 271 aa, Bacillus licheniformis
MITASNTMFELQKQIDNISHNLANTDTTGYKAKNTSFSELIRQQIEQVNEKNNEVAASRKTPPGLRLGVGAVMTDRLTHKQGSLKETGRDLDIALTSPYQYFQVNVGGEVQYTRDGAFYLTPAAGNANQMQLVTKEGHAVLDENGNAIRFNQRYKHIKVDESGSVTVSSDNQGEAPLRFNLGIVRAVKPQALTEEGSNLFSVSDELRATALINLNGAGRQDISLKQGFLESSNVDVSKEMTDLISSQRSYQMNSRAITMGDQMMGLINSVR

SEQ ID NO: 7904 - protein, 279 aa, Bacillus licheniformis
MLKGLYTATSAMITQQRRTEMLTNNIANANTPGYKEDQGSIRSFPEMLLSRIESDSFKAGSASRSFSTQTPIGSINTGVYMQELKPQFSQGDLQSTNEPTDIAISEAEVPVNGETNDKAALFYAVRLENGDVRYSRSSRFSLNENNQLTINGRLVLSTENRPITVGSENFQVAEDGTVTENGQNLGRIDVRIALDTRNLAREGDDLYRTENGEALPSAVGNPEVTYSVKQGMTERSNVDVTRAYTEMTAAYRSFEANQKVLQAYDKSMEKAANEIGRIG

SEQ ID NO: 7905 - protein, 333 aa, Bacillus licheniformis
MFARDIGIDLGTANVLIHVKGKGIVLNEPSVVALDKNNGKVLAVGEEARRMVGRTPGNIVAIRPLKDGVIADFEVTEAMLKHFINKLNVKGLFSKPRMLICCPTNITSVEQKAIREAAEKSGGKHVYLEEEPKVAAIGAGMDIFQPSGNMVVDIGGGTTDIAVISMGDIVTASSIKMAGDKFDLEILNYIKREYKLLIGERTAEDIKIKVATVFPDARHEEISIRGRDMVTGLPRTITVTSKEVEEALRESVSVIVQAAKQVLERTPPELSADIIDRGVIITGGGALLNGLDQLLAEELKVPVLVAENPMDCVAVGTGVMLDNMDKLPKRKLS

SEQ ID NO: 7906 - protein, 91 aa, Bacillus licheniformis
MHDYIKERTIKIGKYIVETKKTVRVIAKEFGVSKSTVHKDLTERLPEINPDLANEVKEILDYHKSIRHLRGGEATKLKYKKEEIFEREPVQ

SEQ ID NO: 7907 - protein, 36 aa, Bacillus licheniformis
MGVFQNSTWKSIKRRSCANSEFFHKTDLISHFSHPF

SEQ ID NO: 7908 - protein, 142 aa, Bacillus licheniformis
MEHINRKIIHQLNQSTRMVAKKTNEQLEAYGLYGSQWSILYCLHTYGPMTQKDIWTYLHVEAPTVTRTVSRLEKNGWVERIQGDDKREKVVKMTEEAKIKYDDIQLKMKEFEEEMLSVFEERDKKIFQRLLSQLLEGHQEEL

SEQ ID NO: 7909 - protein, 397 aa, Bacillus licheniformis
MKQAEPIWTRDFIMVVLINLFIFVYFYALLTVLPVYAMQELGGSESEGGLLISGFMLSAIFARPFSGAVIERFGKKRMALISVVLFTLASFLYIFIHDIYLLLGIRFFQGIWFSIITTVTSAIAADLIPPARRGEGLGYFAMSMNLAVVIGPFIALNLLDKMSFSDLFILFSGIVTVAILCTALVRIPKGNDIRSAVFRLSFSNMFEKGAIRIATVGLFVSFCYSSVISFISVYAKSLGLIEASSYFFMVFAVTMMITRPFTGKLYDKVGPGVVIYPSIIIFCAGLFLLAFTNSSAMLLLSGAVIGIGYGSITPCLQTLAIQSSPPHRSGYATATYFTLFDTGIAVGSYVFGLVVAQAGFSNIYLFSGVFVLINLFLYTWSQKPASAKEKRDISMAE

SEQ ID NO: 7910 - protein, 192 aa, Bacillus licheniformis
MNYWLFTRIHQLANHNDILDGAMILITEKAIYMYALILLLIWIFGNRSYKITVLQAGVTGIFGLAANYLLSLVYYEPRPFVAHHVDVLIHHAADASFPSDHTTGALAISIAFWLYHRKIGSCLIAFGLLTGFSRIWVGHHYPVDVLGSILVALFVSLVMFRFSTYVQPLFERIISLYESILRKLRKAVSRTV

SEQ ID NO: 7911 - protein, 309 aa, Bacillus licheniformis
MSKVLIFGHKNPDTDTICSAIAYAELKKELGMDAEPVRLGEINGETEYALKKFNAEVPRLVNTVANETDSVILVDHNERQQSVDDLDQVRVLEVIDHHRIANFETSDPLYYRAEPVGCTATILNKLYKENGVEIKKDIAGLMLSAIISDSLLFKSPTCTEEDVKAAKELAAIAGVDADSYGLDMLKAGADLSAKTIPQLLSLDAKEFTMGSHKVEIAQVNTVDTNDVLSRKEEVDAELAKAVSEKGLDLFVFVVTDILTNDSVVVASGQAAQAVEKAFNVTLADNTATLKGVVSRKKQIVPPLTEALKG

SEQ ID NO: 7912 - protein, 273 aa, Bacillus licheniformis
MFKHTKVLQYPAKPERPDPVFAKKMQEILGGQYGEISVAMQYLFQGWNTRGNEKYKDLLMDTAAEEIGHVEMIATMIARLLEDAPVYEQEKAADDPVIGAIMGGMNPHHAIVSGLGAMPENSTGVPWNAGYIVASGNLLADLRANVNAESQGRLQVARLYEMTDDKGVQDMLGFLLARDTMHQNQWIAAIKELEEKEGVIVPGTVPPEYEKEEVSHSLYNFSDGEESAQFEWLIGKAPDGAEFHYESGPVAYGEKPVLKPAPKRSHNTPDYGE

SEQ ID NO: 7913 - protein, 245 aa, Bacillus licheniformis
MIKNTSHRPFPLPEGPWMMTQTWNHVLFAHWAVDPEAIRGQIPAALELETFNGKAWIGILPFLLTNMRPRFLPPFPFISRFPELNVRTYVAYKGVPGIYFFSLDAASRLAVAGARSMFHLPYFYAGMRFAQHKDRFQLTSRRKRSQAEFYAEYQPVSEPFSADKGTLEYWLAERYRLYTTHKNELYYEDIHHSEWQLQQAEADIFPDPLTSANDLTLPDTAPLLHYAKRQHVLFWPLKKWESEET

SEQ ID NO: 7914 - protein, 135 aa, Bacillus licheniformis
MKLKDIMTTNAECCEPSAPIAEIAGKMRDYNVGSIPVCENGKLTGIVSDRDIVIRCVAENETDAAARDIMSTQMVTGRPDMSAEEAGDLMAEHQIRRLPIVEDDRLVGIVALGDLSVSHADEKAGEALSEISKPA

SEQ ID NO: 7915 - protein, 318 aa, Bacillus licheniformis
MRVFQGEGWTWYQLGPHEKTTAQGLIQPDHWPECRNWFQGVPSANINCLDINAAVQGKEAIYGSYIYDQEAEVQQNRTAFHFYLTKDYFFTMNLDISQFEEANRRPIDQHLKRCKDAPEVFLVLLGELMRMYLKELEHFEVHLGKVRWGFHHDNNKSIIELIHKRRHELLVIRSLILSMKKVAMGLKETFLTKSFDEIEQRRTFYEIDRGMSLIKEYANEINYLLHSEEVVTSHRGNEIFKALTIFTTIFTPMTAFGALWGMNFEVMPELSLKYGYLFSLILIAVSTALVYWYLKKKGWTGDLLRDKKRYMKRKGSFK

SEQ ID NO: 7916 - protein, 429 aa, Bacillus licheniformis
MKLIAVAGLIAFTGFFVAVEFAIVKVRRTKIDQLIIQKKKGALAAKEVTSHLDEYLSACQLGITVTALGLGWLGEPTMQTLLHPLFSKIGLNESITHILSFLAAFLSVTYLNVVVGELAPKTIAIQKAETVTLLFAQPMIWFYRIMFPFIWLLNHSARMITSLFGLKPTGEHELAYSEEELRTLLSESYRSGEINQNELKYVNNIFKFDERTAKEIMVPRNEMTVLSLDDSLKKAKQLIKETKHTRFPVMEEDKDHITGMINIKELLLAELAGEFSLETKSLKPYIHPVIHVIETIPVYQLFVKMQKEHTHMAILVDEYGGTSGLVTVEDIVEEIVGDIRDEFDTEEVSAVQKLEDDHYILNAKVLVSDVNDLLGIHLSDEEIDTIGGWMLTQNIESKPGTTIESEGYRFKVKEMDGHRIVAVEVEKTA

SEQ ID NO: 7917 - protein, 403 aa, Bacillus licheniformis
MQMGDTVFMFFCALLVWLMTPGIALFYGGLVRSKNVLSTVMHSLSSIAIVSIIWILFGYSLAFAPGNPLIGGLDWIGLHGVGFEPNADYSETIPHTLYMMFQLTFAVLTTAIISGSFAERMRFPAFILFSVLWAVFVYSPVAHWVWGGGWLDELGAIDFAGGNVVHISSGVAGLVVAIVLGKRKNMSDTAPHNLLLTLLGATLIWFGWFGFNVGSALTIDEVAMTAFINTNTAAAAGLIGWILAEWLINKKPTMLGAVSGAIAGLVAITPGAGFVTPFSSVWIGLIGGIVCFWGVFSLKKKFGYDDALDAFGLHGLGGTWGGIATGLFATTSVNADGANGLFYGDISLLWKQLIAIAATYLFVAIVTYAIIKIVSIFFKLRASEDEESLGLDLTLHGEKAYQD

SEQ ID NO: 7918 - protein, 116 aa, Bacillus licheniformis
MSGQMYKVEIVTRPTNFEKLKTELAKIGVTSITFYNVHGCGLQKGHTELYRGVKRESNVYERLKVEIVVSKVPVEKVAETAQNVLKTGEPGDGKIFIYEIKNTINIRTGEEGPDAL

SEQ ID NO: 7919 - protein, 190 aa, Bacillus licheniformis
MNTIPYVIEKTAAGERSYDIFSRLLKDRIIMIGSEFNDDLANRVTAQLLFLSAEDNEKDISIYINSPGGSTSAGYAILDTMDYVKPDVRTICVGMAASMGAILLAGGAKGKRYALKNSEIMIHQPLGGVKGQATDMEISAKRIIKLREKIERFFHERTGQPIEKLKADMERDYFMDADEAKAYGVIDAVL

SEQ ID NO: 7920 - protein, 201 aa, Bacillus licheniformis
MNELEQQALMKYCLRMTGDKWDAEDLVQDTILKLMEINRTDASHAYQKTVAKHKWIDLLRKRKRESFLSEDNLEDGRAERMKAADDFEHLLKQLSGILTPKQLTIFLLKDVFSFQLHEIAETLGKPESSVKSLLFRSRQRLKRLSPEVLQKEPADGDDEHIGLLVRAILHHNPDDLLEFAKQTWRFDASQPSCISMMRCAA

SEQ ID NO: 7921 - protein, 291 aa, Bacillus licheniformis
MKEEEKNRTSKITKLQQFFRKRWVFPAIYLTSAVVVLTAVLWYQSASNNDVKDQLADDGKKSAYDNRDDAVEVGKPVENVAMPVADSENVSVVKKFFETDATKEEKEAALVNYNNTYSMSKGIDLAEKDGKTFDVSASLSGTVIKAAKDPVLGYVVEVEHEDGLSTVYQSLSEVSVKQGDKIEQNQVIGKAGKNLYNEEGGNHVHFEIRKDGVALNPLNFMDKPVSSIEKAMEEQASEVKEPAQPSVEEKSKTEDKAKDQTDGKDDKTKREDSSEGSENQDGTQSDDSSQS

SEQ ID NO: 7922 - protein, 165 aa, Bacillus licheniformis
MKLRIANREDLPAVVDIYNSTIASRMVTADTEPVTPEERLNWFLSHTEERPLYIAENEKRDIVGWISFESFYGRPAYAKTAEVSIYLHEDHRGKGAGSAVLEKALEAAPKLGIRSLMAFIFAHNEPSMKLFKKYGFTEWGHFPGIAEMDGIRYDLKILGKELNEA

SEQ ID NO: 7923 - protein, 147 aa, Bacillus licheniformis
MDMERFHQMPAFMKEEMDNLKRVAAPFLKKRLIFLFIAIPLLLASFVYLSSFWGQAAYGTDSMIKIGCAAAGAAFGMALFRESSYQKRNVQQSVMKYILERMQTSEVLSDERKSRYVRAVKEEPFTVMRSFLEFLNEEEIRRRRLAE

SEQ ID NO: 7924 - protein, 488 aa, Bacillus licheniformis
MDIIKNISITSIFLGFILVLNTLLAIVVIFRERRDASSSWAWLLVLFFIPVLGFILYLLFGHNLSRNHLFQWEDRKKIGIEKILEQQLTKLKNREFEFRNKATADSKDLIYMHILNNHAVFTEDNAVELLTDGRQKFDRLLRDIENAKDHIHLQYYIYKGDEIGKKLRDALIKKAKEGVEVRVLYDELGSRSLRKSFFKELKKAGGFVEVFFPSRFKFINLRMNYRNHRKLVIIDGVIGYVGGFNVGDEYLGLNPAFGYWRDTHLRIKGTAVHSIQTRFILDWNQASHHHDITYMPNHFPDIDSHGNIGMQIVTSGPDSEWEQIKNGYIKMISTAKRSILIQTPYFIPDASLLDALRIACLSGVDVRIMIPNKPDHPFVYWATYSYIGELLKAGASVFIYDNGFIHAKTIVVDEEISSVGTANIDMRSFKLNFEVNAFLYDEEIARSLVLSFEKDLQVSRELTFEEYLNRSKSIRFKEAISILLSPIL

SEQ ID NO: 7925 - protein, 477 aa, Bacillus licheniformis
MNRRPFNQRTVVSIVYVTAMFMAAMDASVINMALPAIMTEFQTLPSAAGTVNIGYLVSLAVCLPAAGWLGDRFGTKRVFLAALSIFTAASALCGIADNLAALNAFRVIQGAGGGLITPVGMAILFRTFPPHERAKISRVLVLPIAVAPAVGPIISGFLTDQLSWRWIFYINIPIGMIILLFGLLYLHEHLEPEAGRFDWLGFLLAAPGMALAVFALSQGPARGFGSPDVLAAGAGGMMLLAILVFVELKAEHPLIELRLLKDRVFGMMSVISLLTAGGLLGMLYIFPLLCQEALGYSATDTALITFPEALGLMLASQLMPRSLAKLGPRRVISVALLGAAVLFGLLSLTGYGSNLWLLRLLLFLAGFFLGHAVGAAQVVCFANISSSSMGRATTLFNVQNRLGSAFGVAVMSCVLAVLSQPSAGIEPDLSAYRTALLCAAGFLMAALFIALKLKDADTGRQMDKHASAPKGAAASGE

SEQ ID NO: 7926 - protein, 74 aa, Bacillus licheniformis
MTNPFENEHGTYVVLMNQDGQYSLWPAFIHIPAGWEVVCGEASRSACIDYISSNWTDLSPNSIKLVAEVHGGQQ

SEQ ID NO: 7927 - protein, 2385 aa, Bacillus licheniformis
MPECQHNRKPLSGAQAGIWFAQQLDPENPIYNTAEYVEIKGPLDQELFEKALRHVIKEAESFHARFGEDQDGPWQEIVPSTDFPLHYIDVSSETDPEQAAKSWMMDDLARPVDLTRGPLFTEALFKAAQDHYFWYQRTHHIATDGFSFTLIAERLSKIYTALMQNKSIDQSGAFGSLDLILAEETAYRASEQYQEDRRFWLGRFSDEPEVVSLAERAPRTSSSFLRRSEHLPSEDADRLLSAASRMGATWHETVMAAAAIYVHRLTGANDVVLGMPMMCRLGSAALHIPGMVMNLLPLRIGMQPQMSIGELVKQISGEMMKLRRHQHYRHEELRRDLKLLGENQRLFGPQLNLMPFENRLNFAGCQGIVHNLATGPVDDLSINIYGRPDGGGLKVNMDANPAVYHADELEDHGNRFLTLLKTIAVCEQTQPVGTLDILLPEERAQILIEWNQTEHGLPKESLPQRFERMAKECPESPAVVCNDKVLTYSELNQKANQLAHLLIDQGAKPETFIALALPRSAEMVVSMLAVLKAGAAYLPIDPDYPADRIEYMLNDAQPLLVMTSKEAQDTIGSQMPKLILDEQTVMEKMSGCSEENPGEQHSGNQPAYMIYTSGSTGRPKGVVVQAESLFNFLLSMQDMFALNQDDRLLAVTTIAFDISALEIYLPLISGSAVVLAEKETVQDPSELAKMIETYEITIMQATPTLWHALASSAPEKLKGLRALVGGEALQSSLARQLQQLACSLTNLYGPTETTIWSTAAALEGNCTEPPGIGCAIWNTQLYVLDAGLQPVPPGTAGELYVAGTGVARGYLNRHALTAERFIANPYGPPGSRMYRTGDIVRWREDGSLDYIGRADHQVKIRGFRIEMGEIEAVLANHPVVKQAAAIVREDQPGDPRLFAYAVPASGESLDPAELRRFVGETLPDYMIPSAFVILDELPLTPNGKLDRKSLPAPAVSMHTGGREPRTPQEEILCDLFAEVLGVPRVSIDDSFFDLGGHSLLAGRLVGRIREMLGVELGIGRLFDEPTAAGLAKQLDQAQSARPALRKRERRKEIPLSFAQRRLWFLHCLEGPSPTYNIPVVVHLTGDLDQKALAAALGDVATRHEPLRTIFPDQQGTTHQLILEEDQSRPELTVSHVSEHELEKVLAEAVRHRYHLEKEPPFRAQLFVLGPDKFVLLLLLHHMIGDGWSLMPLTRDLETAYNARLQGEAPVWEPLSIQYADYAVWQEYLLGSENNPDSLIAKQLEYWSKALEHLPDQLELPTDHPRPSESSYRSGTIDLSIDEQLHGRLFDLSRSTGVSMFMILQSALAALLTRLGAGHDIPLGSPIAGRNDDALGEIVGLFVNTLVLRTDTSGNPSFRELLNRVRKVNLAAYEHQDLPFERLVEVLNPRRSRARHPLFQIMLAFQNTPEPELDLSGLKSDIEIRSVGAAKFDLTIELREHRKADGTPAGIGGFLEYSTDLFERNTVQTLAERLVRLLDSAADDPDQPIEKLDILLPAERENMLADWSKSSNSIPCSSLPVLFEKQAAKDPEAVAVICENNALTYGELNKRANRLAHLLIAKGVGPEQFAALALPRSLDMVVGLLAVLKAGAAYVPLDPDYPAERIAFMLNDAHPVCIVTSSAVESNLSVPGSVERIVLDDPCIQEELKGCAAANPCDADRTAPLLPLHPAYVIYTSGSTGKPKGVVVPHQNVVRLFGATDQWFHFGADDVWTMFHSYAFDFSVWEIWGALLNGGRLIVVPHTISRSPAEFLNLLVREGVTVLNQTPSAFYQLMQADRDNAETGKLLSLRFIIFGGEALELKRLEDWYERHPDHFPRLINMYGITETTVHVSYISLDQQTAALQANSLIGQGIPDLGVYVLDEYLEPVPPGVTGEMYVSGGGLARGYLGRPDLTADRFVADPFGPPGTRMYRTGDLARRRQDGSLDYMGRADQQIKIRGFRIELGEIEAVLVRHHRVNQAAVVVREGQPGDKRLIAYVVPASEEETDPAELRRFAAGTLPEYMVPSAFVKISELPLTPNGKLDRKALPEPDFAAAVKGRGPRTPQEEILCDLFSEILNAPRVGIDDGFFELGGHSLLAVQLMSRIREALGVELGIGDLLEAPTVSGLAERLESGGRQSALDVMLPLRTGGSQDPLFCVHPAGGLSWCYAGLMTALGKEYPIYGLQARGIARQEELPDTLDDMAADYIRHIRTIQPTGPYRLLGWSLGGNVVHAIATQLQEQGEDISLLVMLDAYPNHFLPIKDAPDEQEALIALLALGGYDPDSLDGAPLNLSSAIDILRRDGSALASLDEAAILNLKETYVNSVRILSEYKPRVFHGDILFFKSTVIPEWFDPIDPESWLPYLNGNIDIHDMDCRHKDLCQPEPLAEIGRRVSEKLDDLKKDTDK

SEQ ID NO: 7928 - protein, 308 aa, Bacillus licheniformis
MAIPAILPYQMPEASNMPKNKVSWTPHPKRAALLIHDMQQYFLNAYRYGESPVTDLLANIKKLRKRCAELGMPVIFTAQPGAQTPEERGLLQDFWGPGIGPDPDEQKIVDELKPNEGDIVLTKWRYNAFRKTNLLGVLEEQGRDQLIITGIYAHIGCLMTACDAFMQDIETFFVGDAVADFSLKHHEMAITYAADRCSVTITAEQLLSRLKDGESHEHAKESSHALTKQIIREQVASLLLESPEKISDSENLIYRGIDSVRIMSLAERWRRAGREVSFVELAEDPSIENWWRLLSSSKEAPLPNADYQ

SEQ ID NO: 7929 - protein, 540 aa, Bacillus licheniformis
MLKGCTTWPKEFADKYRKEGCWRGETFGKMLRERAEKYGSRIALTYGDIHLSYRELDRRADSLAGGLLKLGIKKNDRVVVQLPNIIEFFEVCFALFRIGALPVFALPSHRHSEITYFCEFSEAAAYIIPDRHAKFDYRKLARQVKEKLQGLRHVIVAGEPEEFEALASLYDQPAPPQNVYPEDVAFLQLSGGSTGLSKLIPRTHDDYIYSLRVSAEICRLDHNSVYLAALPIAHNYPLSSPGVLGTLYAGGRVVLASGGSPDETFPLIDKERVTITGLVPPLALIWLDAASARRDDLSSLQVFQVGGAKFSAEAARRVSSVFGCKLQQVYGMAEGLVNYTRLDDPEDTIVHTQGRPMSPFDEIKIVDEKGRELGPGQTGELLTRGPYTIRGYYKAEEHNAKAFTEDGFYRTGDLVKVNSSGYLIVEGRAKDQINRGGEKVAAEEVENHLLAHPGVLDAAVVSMPDQFLGERACAYIIPRGAAPAQAELQSFLRERGLAAYKIPDRVEMVEDFPQTGVGKVSKKELRAAIAEKMSAAENVR

SEQ ID NO: 7930 - protein, 396 aa, Bacillus licheniformis
MIERHVVSEALADQLLKEYQAGASFFFSSPERTILAEGVFASVSQTEEQSLAQRTAEVLKKARENGQENPIVVGAVPFDDAKPAQLTVPVEAWHAGPLTCEEDDKEVPEPALHPYDVQQIPSPEAYMAGVRQGLAGIAAGEYSKIVLSRSLQLTSPIKVDIGQLLRNLARRNTSGYNFAVDLTGQSSEAPRTTLIGASPELLVSRSGFCVTANPLAGSRPRSDDPEEDRRRAAELLASPKDRHEHAVVVEAVASALRPFCRKLEVPEPSLISTPTMWHLSTELKGELTDLSVSSLELAAALHPTPAVCGTPTNAAKEAIKQIEPFDRGFFTGMVGWCDADGDGEWVVTIRCAEAEEHALRLYAGAGIVAGSKPEDELAETSAKFRTMLLAMGMNSE

SEQ ID NO: 7931 - protein, 256 aa, Bacillus licheniformis
MKGKVALVTGASQGIGKEVALALAGRGVFVAAADQNRKGLLELEDELEQKGLQGSGFAADVGDSAAVDQLIADIEREIGPIDMLVNVAGVLRTGLIHSLSDEDWEKTFNVNSTGVFNVSRAVARRMVPRRTGAIVTVGSNAAAVPRMHMAAYAASKAAALMFTKCLGLELAEYNIRCNIISPGSTDTPMQRSLWQCEEAAQGVIEGSLETFKTGIPLGKLASPADIADAVVFLLSDGARHITMHDLRVDGGATLGA

SEQ ID NO: 7932 - protein, 282 aa, Bacillus licheniformis
MAQEKLQQSVNAAECIPVAIPGTEQRCMRSLDGSRTYRIFIAKPFGEQPPAGYPVIYLLDANSVFGTMVEALRMQSRRPDKTGVGTAVIVGIGYETDAPFDRGRYYDFTLPESGAELPMRPDGADWPEPGGAKAFLSFIEQQLKPEIEQEFTIDVKRQAIFGHSLGGLFVLQTLFTKPDLFQTYIAGSPSIHWHPSFFDKEHDFVSKLQEADGDVKVLLGAGELEKTHKSGMNDNAKRLADRLAALESQGVRAEYHEFKGEGHISVLPVLISRALRFAFKPD

SEQ ID NO: 7933 - protein, 339 aa, Bacillus licheniformis
MPKKVAVIYAVFIVLILTICYLSITVGSFAVHPAELLSTLLHINPNEQYAILLFELRLPRIVTAALVGLGLGIAGSVIQAMTRNGLADPGILGINAGAGAAIVGYMLIFQGQTETTSLLAAMGMPFFGLIGGILAAIFIFIFAWHAGNLDSGRIILVGIAINSGFSAVSLYLSLKMNPNDHEMAMVWKNGSIWSANWTYIQAALPWLLVLIPFLLMKSGLLDTIRFHEDTVKSLGVSANIEKVVLLTACVGIISACVAISGSMAFVGLIAPHISRRLAGVLHRHSLLLSGLIGMFLVLCADFAGKLLFQPSEVPAGIILAIFGVPYFLFLLFKQKKTVH

SEQ ID NO: 7934 - protein, 334 aa, Bacillus licheniformis
MHSKQMTRIIMIAAPFAILLSVFLSVCYGAKQLEPEVIFSALLHFDPGNTDHQIIWHSRLPRAVGALLIGAALAVSGALMQGVTRNYLASPSIMGVSDGSAFVITLLMVVIPGSSSLEMMGYSFIGSAVGAGLVFGLASVIPNGFMPVQLAIIGTVTSMLLSSLSAAISIYFQISQDVSFWYSARLHQLNPELLKYAVPFFVIGIILALSLSKKVTALSLGDDISESLGQKKQAVKWTAMAAVVVLTGCSVAMAGKIAFVGLVVPHITRFLVGSDYSRLIPCSCVLGGVFLTLADLLSRLINYPFETPIEVVTSVIGVPFFLYLIKRKGGEQRA

SEQ ID NO: 7935 - protein, 318 aa, Bacillus licheniformis
MRKISIFLFILLLALGAAGCGNSKEKAGGDGKSTASAEKSIEYLDHTYKVKIPAEQIVITGSVESMEDAKLLDVHPAGAISFSGKFPDLFKSITDKATAVGEKMEPNLEKILELKPDVILASTKFPDKVVKKLDNIATTIPVSHVSSNWKDNLKLLAELTGKEDKAKQIISDYEADLKEAKTKLEKTAKDTKALVVRIRKGNIFIYPEDVFFNSTLYGELGFTAPKEVKAAKAQELVSLEKLSEMNPDYMFVQFSDDENADNPNALKDLEKNPIWKSISAVKNDRVFVNAVDPLAQGGTAWSKVEFLKAAAEKLAQNK

SEQ ID NO: 7936 - protein, 531 aa, Bacillus licheniformis
MKSSYFYRLLQIDHIRKPGDLPDEQQLADSFVLIFHLKGEGRIDIQASGRPLQKETLYIVPPYETFGITASSEEISVYLIRLQPYCYEDRRLTLQADTDPDAFSDLQMMNVHPVGNLASRLQELSALWPASSALQELKCQADLQQLLYDIYSAKLTHPENTASAIGKTKEYIEEHSDAHLTLDQLAQMAGISAKHYSERFKKLYGQSVTEFITETRMTKAKQLMAKASYKLREISSQIGYQDEFYFSRTFKKHTGLSPTVYMKKRRRKLAAYGQNTIGQLIPLHLIPYAASLHPKWTSYYYKHYAADIPVHLSAYRFHEPWEENLRTLSSADPELIISMDSVSHEEREQLQSIADVFFLPSQEQWRRHFMLTASHLDEEAEAHKWLLSYQRLTETAKEALYPICGRRSFLFLRLHKHEIYLAHNRSVQDVFFGDLGFESAVSLEEPTDRAVSIETIAAYQPDIIMIFIFKEPETLAFYRELQQSAAWQDLKAVRHHRVYQVNSDPWREYSACSHERIIRQAVRLLSGKNPF

SEQ ID NO: 7937 - protein, 130 aa, Bacillus licheniformis
MEMTDSMKKSLDAIAKWGKITGVFMIIAGGIYAFFGISLLIIGAAPGVLMIFSGIYLLKSANAAQKMSHDMPQEPHEALLDNYVKFMKWQFFYLLSNIVIFILCIIVFFFLIFLGVLADSYSGYDPYYYE

SEQ ID NO: 7938 - protein, 286 aa, Bacillus licheniformis; identical to SEQ ID NO: 4681

SEQ ID NO: 7939 - protein, 110 aa, Bacillus licheniformis; identical to SEQ ID NO: 4682

SEQ ID NO: 7940 - protein, 213 aa, Bacillus licheniformis
MKIGIIGASGKAGSMILKEASERGHEVTAIVRSASKMANSDAAVIEKDIFNLTAADIKGLDVVVNAFGAAPGQEHLHVEAGRKLIELFKQVPETRLIVVGGAGSLYVDEEKTTQLYDTPEFPKEYLPTAKNQGQNLQDLKEADGLKWTFISPAAFFNPEGKRTGSYQKGQENLIVNTAGESYISYADYAIAVVDEAEKGEHVNERFTVVGEAQ

SEQ ID NO: 7941 - protein, 133 aa, Bacillus licheniformis
MVNTRLSVAIHILSLIAANPRESSEMIAGSVNTNPVVIRRMISQLKKAGILTSRPGVAGASLKRDPEDISLLDIYRAVQPHEELFAIHDKPNPNCPVGRQIQTTLDQTFHSVQQAMENELASKSLKDVLTHLF

SEQ ID NO: 7942 - protein, 179 aa, Bacillus licheniformis
MKEITEGKAALDSRLEPNEEIRSIILCAYNARLSARYTPYRGVLAATDRRFMFYSSLFGSPFHLDIRYDAVTSFRREKGLVTRGDHLVVMNNGDREAFQYFSGCDPLETFVEAVRKLKKLPEDIIHSEKRRLRDVPAAGCSVINIVLLSIPQHFINCHSIRKMIFGIPHGNQSKKYIIG

SEQ ID NO: 7943 - protein, 159 aa, Bacillus licheniformis
MFGLQDIVKFLWSFLIVFPAVSVLHVLGHSAMAVLFGGKSSLEIGMGKKLLKIGPVQIRSVYFMDSFCKYGDLKYDNRFTNAMIYAGGSLFNLMSIFIINLLIIKDIIPENIFFYQFVYFSTYYVFFALIPVRYSENHLSDGMAIYKVLRYGEKYDINN

SEQ ID NO: 7944 - protein, 342 aa, Bacillus licheniformis
MNTNSEQVLDQKSRPLRDLRISVTDRCNLRCTYCMPAEIFGQDYPFLPKGELLSFEELERLAKLFVHQFGVEKIRLTGGEPLMRKDMPELVGKLAGIKGIRDIAMTTNGVLLPVYADKLKKAGLKRVTVSLDSLDDERFKSINGRGVSVSKVLAGIEAAKKAGLGVKINMVVQKGVNEKDILPMARYFKEKGHILRFIEFMDVGNTNEWNRQSVVAKADIIRIINEDMPIEPIDPNYEGEVAKRYRYLDGSGEIGFISSVSDAFCTTCNRARLSAKGELFTCLFASSGFDLRTLIRSGQTDQELAEAIGTVWRNRDDQYSLDRALAKAVPRKKVKCPILEDN

SEQ ID NO: 7945 - protein, 263 aa, Bacillus licheniformis
MGKNITTSRKIFRYDNGELVQQEDQMATEFPLTVMVNGEEFVTLVCSPDSLEELVIGFLASEGVIRFKNEIKRFTIDESLGFAYVDLVSTKKLQLKDYTKRVIGSCCGKGRHFYFQQDVKTAKTAIDGVTITPENCLKLMRDMQKSSKLFHHTGGVHNAALCSTDKLIAVRSDIGRHNALDKLYGYCLLHQVPVRDKLIVFSGRISSEVLLKAAKIGVSAVISKSAPTELAIQMAEELNIMTIGFARNRSFNVYTHHERIQFS

SEQ ID NO: 7946 - protein, 420 aa, Bacillus licheniformis
MKKAKNRWLIALCAVGIHLSIGSVYAWSVFTNPLAETFGWSLSQISLTFSIAILFLGLSAAFLGHFVEKHGPKKAGMLAALFFGAGVTFSGFAVQIGSLPLLYLFYGVFGGIGLGVGYITPVSSLVKWFPDRRGLATGLAIMGFGFAALISSPIMQKLISAVGIANTFFILGICYFLVMMLSSLYLAPPEEGWQPEGFSTGKSGRAQSADISQLTANEAIKTKRFYYLWLMLFINVTCGIAIISIASPLAQESAGMSAAAAAALVGVLGAFNGLGRIGWASVSDYIGRPNTYTVFFAIQLIAFPLLPFISDKAAFSVLMALIYTCYGGGFAAIPAYIGDLFGTKQLGAIHGYILTAWAAAGLAGPMFSSWVRDATGSYSQSLTVFAALFAIALFISIFIRTDIKQLRKKAAVHVSNSLKG

SEQ ID NO: 7947 - protein, 783 aa, Bacillus licheniformis
MGKTKHQGPMKLNKKPAPKLWASWAPMGLGKVKPKHIRDTMKTAWDNKDNLPYAYRILTQGVCDGCALGVSGLRDQTLTGPHLCTTRLNVLRLNTMPAIEDKWLSADIEQLRKLDSTELRKLGRIPYPLSRKNGERSFSRISWDEALSRIADKIKSIDKRQLAFYLTARGITNEVYYTAAKAARFIGTNNIDNASRICHSPSKTALKRSLGIGASSCSYRDWIGTDVLVFWGSVAANNQPVSTKYMYAAKKAGTKIIMINPYREPSMEKYWIPSIPESALFGTKITDDVYQVNIGGDIAFMNGVMKHWFEMEREAPGSSIDRAFIDAHTNGFTELKQHIEKQNWKTLEESSGISKERMKEFAVLLARAKTGVFIWSMGLTQHRFATDNISQVANLALLQGFIGRKHCGVMPIRGHSGVQGSGEMGADPFVLPGGDFDEENAARIEKVWGFRLPTWQGDTIGQTIENMLLPSGSERKVKVFYTSGGNFLETMPNPDFIKKALQEVEVRVHQDIIFNTSTLVDAKEEVIILPAMTRYEQPGGGTSTSTERMVYFSPEIKGPRIGEARSEWEIYVDLAKRVRPEDKELIHFDGAAEIREEIAAANRNYDGIQHLKKRGDVFQWGGAWLCEGGVCPTADGRGNLIPVDLPENRQTEGRFLVTTRRGKQFNSMIYSEKDPFNAADRRDVMINPKDAEELYIQDGEAIVLFNRYGTFQGRAKYAGVQRGNTAVYWPEGNVLIPKGVYENHARIPEYNTAVMIEKAEIFHSRKDPRYAEKRIEELEMSTD

SEQ ID NO: 7948 - protein, 230 aa, Bacillus licheniformis
MKKRFALLTTFTMLLSLAPAAAFAAENGNADNSKKDVNVAVVLDASGSMAQKVEGERKFDIAKESVTDFADLLSSDANVMLNVFGHKGNNKNSGKEVSCGTTETVYDLQPFSFNSFENALSGIKPTGWSPIAKSLYDVKDDLADKDGKNYVYIVTDGEETCGGDPVQAAKDLRKSNIKTIVNIVGLDVKTVKEKAKLKKVADAGGGKLIEADSASDFKKVWKEEGVKLSQ

SEQ ID NO: 7949 - protein, 228 aa, Bacillus licheniformis
MKKKMTLGILTAMVLSLGSPAFAAEKKQEVTVAEDAPNVAIMLDASGSMAKKIGGVSKYELAKNEAFSFGSKLENANVLMRVFGSEGNNKNSGKVQSCNAIRGVYGFQTYDEQSFRNSLNGIGPTGWTPIANALQDAKNALDQLDNNGKNVVYLLTDGEETCGGNPVKVATELRKSNAVVNVIGFDYEGDFHGQLTSIAAAGGGEYFQAKTKNDIKRIFTQEAIELSK

SEQ ID NO: 7950 - protein, 338 aa, Bacillus licheniformis
MKQLIIVLAGICTLILLIPTLLVLPFHGGPGAIKTEKHAQQHEEKKKVTLKESPVSIPVYRTADRKVEDIPLEEYVIGVVASEMPADFDIEALKAQALAARTYIVRQMVSEQAVQSPKGSLVDDTQMFQVYKNKEELRRLWKKDYDWKIKKVTEAVASTQGKILTYEHKPIDASFFSTSNGYTENAGAYWTSDIPYLQSVKSSWDTKSPKFLNHKTFTVAEFEQKLGVKLPGSNSIGEITERTPGKRVATAVINGKKLEGRDIREKLGLKSADFDWKRDGNQITVTTRGFGHGVGMSQYGAHYMAKDGKKAEDIVKYYYKGTAVSNADEFLNKYMAKK

SEQ ID NO: 7951 - protein, 436 aa, Bacillus licheniformis
MEKIIVRGGRKLNGTVKVEGAKNAVLPVIAASLLASEEKSVICDVPTLSDVYTINEVLRHLGASVHFENNTVTVDASRTLSTEAPFEYVRKMRASVLVMGPLLARTGHSRVALPGGCAIGSRPIDQHLKGFEAMGAKIKVGNGFIEATVEGRLQGAKIYLDFPSVGATENLIMAAALAEGTTTLENAAKEPEIVDLANYINAMGGKIRGAGTGTIKIEGVKALHGAKHTIIPDRIEAGTFMVAAAITEGNVLVKGAVPEHLTSLIAKMEEMGVQILEEGDGLRIIGPSELKPIDLKTMPHPGFPTDMQSQMMALLMRANGTSMITETVFENRFMHAEEFRRMNGDIKIEGRSVIINGPVQLQGAEVAATDLRAGAALILAGLVADGHTRVTELKHLDRGYVNFHQKLAGLGADIERVNDEEAVHIENKEVVSDLNA

SEQ ID NO: 7952 - protein, 247 aa, Bacillus licheniformis
MKTKQTVNALIFIVVLFLIVHVFQSLEAAGNTPLEQLAEGLSRHDVELEEWTMHTKKQLTLSEKDFFAKLKHFKKQHRQYEWTLTREDDDTVKATGVFQDKKNHINSKIHLVSTHKNQRLVSYLLYEQKGAGPRENWNATYKQFERDAFDIMREKTAIFTCLKGHLNGMMNVVLQKKANELVHEFDAKSVEDLIEPNFVSISAYTNEWKESIKTEKHRMNLQVSLRNAGMGEKLTVTVGTPIVTTEY

SEQ ID NO: 7953 - protein, 77 aa, Bacillus licheniformis
MEEIGQQAAVSIIVHLFFIALTWWALLAVNIDPLIRKGKVIQARVLMIIITIAVGSTVSNFFLDYLYYSRQLQNLFS

SEQ ID NO: 7954 - protein, 131 aa, Bacillus licheniformis
MKTLKVNIVTPDGPVYDADIEMVSVRAESGELGILPGHIPTVAPLKIAAVRLKKDGQTELVAVSGGIVEVRPDHVTILAQTAETSEQIDKERALAAKRRAEERLQKQTPDVDIIRAELALKRAINRLDVAR

SEQ ID NO: 7955 - protein, 473 aa, Bacillus licheniformis
MKKGRVSQVLGPVVDVRFEDGHLPEIYNAIKVTHKAQNENEVDIDLTLEVALHLGDDSVRTIAMASTDGVTRGMEAIDLGEPISVPVGNVTLGRVFNVLGENIDLDEPLPADAAKDPIHREAPKFDQLSTEVEILETGIKVVDLLAPYIKGGKIGLFGGAGVGKTVLIQELINNIAQEHGGISVFAGVGERTREGNDLYYEMKDSGVIGKTAMVFGQMNEPPGARMRVALTGLTMAEHFRDKEGQDVLFFIDNIFRFTQAGSEVSALLGRMPSAVGYQPTLATEMGQLQERITSTNVGSVTSIQAIYVPADDYTDPAPATTFAHLDATTNLERKLSEMGIYPAVDPLASTSRALSPEIVGEEHYEVARSVQQILQRYKELQDIIAMLGMDELSDEDKLVVSRARRVQFFLSQNFHVAEQFTGQKGSYVPVKETVKGFKEILEGKYDHLPEDAFRLVGRIEEVVEKAKEMGVEV

SEQ ID NO: 7956 - protein, 268 aa, Bacillus licheniformis
MSQITKAQEMVSASKLNRAENKAKSFVPYMEKMQEVVADIAVGYTGKHPMMSSRPVKRTGYLVITADRGLAGAFNANVLRKAYQRIQERHQSKDEYAVIAVGRMGRDFFKKRGIPVISEMTGIRDEVTFSEIKDLANSTVQMYIDETFDELYLFYNHFVSAISQEVTEKKLLPLTDIAPNKKKTSFEFEPDEEEILEVLLPQYAESLIFGALLDSKASEHAARMTAMRNATDNAKEIIADLELSYNRARQASITQEITEIVGGAAALE

SEQ ID NO: 7957 - protein, 502 aa, Bacillus licheniformis
MSIKAEEISTLIKQQIENYQSEIEVHDVGTVIQVGDGIARVHGLDNCMAGELVEFSNGVLGLAQNLEESNVGIVILGPYKDIREGDEVKRTGRIMEVPVGEELLGRVVNPLGQPVDGMGPVLTSKTRPIESPAPGVMDRKSVHEPLQTGIKSIDALIPIGRGQRELIIGDRQTGKTSIAIDTILNQKDQDMICIYVAIGQKESTVRGVVETLRKHGALDYTIVVTASASQPAPLLYLAPYAGVAMGEEFMYNGKHVLVVYDDLSKQATAYRELSLLLRRPPGREAFPGDVFYLHSRLLERAAKLSDAKGGGSLTALPFVETQAGDISAYIPTNVISITDGQIFLQSDLFFSGVRPAVNPGLSVSRVGGSAQIKAMKKVAGTLRLDLASYRELEAFAQFGSDLDKATQAKLNRGARTVEVLKQDLHKPLRVEKQVAILYALTRGFLDDVPVEDIKRFEEELFMYLDQNHKDLLDSIAQTGNLPADEDMKGAIEGFKRTFAPSN

SEQ ID NO: 7958 - protein, 184 aa, Bacillus licheniformis
MSQSAVSKRYAAALFDIALESKLVNEIEEELTVVKKIFIEHKDLNAVLGHPKVPAEKKKQILKDSFGSVSTAVLHTLYLLVDRSRTSIVPDLADEYVKMANRFRGTEDAIVYSVKPLSEEEISSFSQVFAKEAGAASLRVRNEVNPDLIGGVKIRIGNRIYDGSVRGKLDRIERQLAGENRKKG

SEQ ID NO: 7959 - protein, 165 aa, Bacillus licheniformis
MGAGVGFNAGTMLFQLVAMLILLALLKKYALGPLLNIMKEREDYITGEISSAEKKNEEAKKLIEEQQALLKEAREESQSLIENAKKLGEQQKDEIIKAARQEAERMKESARSEIVKERDQAVTALREQVASLSVMIASKVIEKELDEQAQEKLIQDYLKEVGESR

SEQ ID NO: 7960 - protein, 244 aa, Bacillus licheniformis
MNHESRIVNFLGLNFDLTSILMITVTSIIVFLIAVLTTRTLAIRPTKAQNFMEWIVDFVRNIIGSTMDLKVGRDFLALGITLLMYIFVANMLGLPFSITVGHELWWKSPTADPAVTLTLAVMVVGLTHYYGVKRKGLGEYTKDFFRPIPYLVPLKIIEEFANTLTLGLRLYGNIFAGEILLGLLAGLATNFYSQSIFLGLVGTIGAVVPMIVWQAFSLFVGTIQAFIFTMLTMVYMSHKVSHEH

SEQ ID NO: 7961 - protein, 105 aa, Bacillus licheniformis
MLGYGFLPYQAIFLGLITGTVFSYFNLWLLAKRMQAFDKAVAKGKMIRSLGTASRLCNAIIAAAIAYKYPEYIHLAGVIVGLMTIYPVIMIDSFIQLKRSSMEER

SEQ ID NO: 7962 - protein, 209 aa, Bacillus licheniformis
MGKVYVFDHPLIQHKLTYIRDVKTGTKEFRELVDEVATLMAFEITRDLPLEEVNVETPVQMAKSNVIAGKKLGVVPILRAGLGMVDGILKLIPAAKVGHVGLYRDPETLKPVEYYVKLPSDVEEREFIVVDPMLATGGSAVEALNSLKKRGAKNIRFMCLIAAPEGVDEVQKHHPDVDIYIAALDEKLNEKGYIVPGLGDAGDRMFGTK

SEQ ID NO: 7963 - protein, 415 aa, Bacillus licheniformis
MKHLPAQDEQVFSAIQDERKRQQSKIELIASENFVSEAVMEAQGSVLTNKYAEGYPGKRYYGGCEHVDVAEDIARDRAKQIFGAEHVNVQPHSGAQANMAVYFTILEHGDTVLGMNLAHGGHLTHGSPVNFSGVQYNFVEYGVDKETQYIDYEDVREKALKHKPKLIVAGASAYPRTIDFKKFREIADEVGAYVMVDMAHIAGLVAAGLHPNPVPYADFVTTTTHKTLRGPRGGMILCREEFAKQIDKSIFPGIQGGPLMHVIAAKAVSFGEALKDEFKTYAQNVINNAKRLAETLKKEGIELVSGGTDNHLVLVDLRSLGITGKVAENVLDEVGITVNKNAIPYDPEKPFVTSGIRVGTAAVTSRGFDLEAIEEVGAIIALALKNHEDEAKLEEAKQRVEALTNRFPLYTGLDY

SEQ ID NO: 7964 - protein, 180 aa, Bacillus licheniformis
MKNLEQTWRSILDEFHQQANLREGHIVVIGCSTSEVAGRRIGTSGSEQIAEAVYKGLEELRDRTGIALAFQCCEHLNRALVVEEETAKAYRLPVVFAIPVPKAGGSMASYAYKHMKAPVLVEQIEADAGIDIGDTFIGMHLKPVAVPVRVSQKQLGEAHVTLARTRPKLIGGVRAVYEAE

SEQ ID NO: 7965 - protein, 149 aa, Bacillus licheniformis
MKVIIASDHGGINIRKEIMALMDELNIEYEDYGCECGSGSVDYPDYAFPVAQKVANGEADRGILICGTGIGMSISANKVKGIRCALVHDVFSAKMTREHNDTNVLAMGERVIGPGLAREIAKVWLTTEFSAGRHAVRIGKIADYEDKHE

SEQ ID NO: 7966 - protein, 151 aa, Bacillus licheniformis
MNILFVCTGNTCRSPMAEALFKSAAAEKNLDVSVKSAGLFAPENGKASLYAVEALFEKNIALNHTSSQLSEEKVEWADLVLTMTEQHKQLAVHEFSKSQDKIYTLKEYVNGDGGDIIDPFGGSLSDYQRTRDELEQLLRKLAEMLAKKSQE

SEQ ID NO: 7967 - protein, 186 aa, Bacillus licheniformis
MNVDVLIGEILTLSMMAFALGMDAFSVGLGMGMAKLKRNQVFQIGVIIGLFHVIMPLGGMIAGQFLSGALGALAGYIGGALLLVLGIQMIVASFNKSGEQIISPHGFGLFVFAVGVSLDSFSVGLSLGLYGTKPILTIFLFGLFSMVLTWAGLLLGKKVQTWLGAYSEALGGAILLSFGLKLLLPI

SEQ ID NO: 7968 - protein, 347 aa, Bacillus licheniformis
MKTKVWTVDVKRDLSTNCPQIAQAARLLQQNETVAFPTETVYGLGANAKHSEAVAKIYEAKGRPSDNPLIVHIAEIEQLAEFAEVDSPQAEMLMKRFWPGPLTLVLPCKPGVLSTRVTAGLDTVAVRMPDHPVALELIRQAGVPVAAPSANLSGKPSPTKAEHVVNDLNGRIAGVVDGGPTGVGVESTVVSCTGEIPVILRPGGVTKEQLEEAAGPVLIDQGLTDEKKAPMSPGMKYTHYAPEAPLAIVNGGVEDIQRLIDQYQKDGMKVGVLTTEERADVYQADAVRICGRRDRLETVAAGLYDVLRSFDEERLDFIFAESFPEEGVGRAIMNRLLKAAGHRVIEA

SEQ ID NO: 7969 - protein, 147 aa, Bacillus licheniformis
MFYQLRLAETKDMNAIEAFLKKAGTSHKGLEEAKSQFIMMEDPPDEIVACLGMEEFENKKGLLRSLVVSDKLSQGHIVSLFQSMQVLCEKRGIQTLYLVANKRTSMDFLEVLGFKQAAAIPDELDESEHVSDSLNVNGAVLMEKTSN

SEQ ID NO: 7970 - protein, 221 aa, Bacillus licheniformis
MKKSNIACMYIFLLLIGALANLTTEETAQSSGGQPAVIPDEAIRLRILANSDSGSDQSVKRKIRDEVNKQITKWVENLTSVEEARQVIRSKLPEIQEVAMDVMKRENVRQSVSVRFDRVSFPTKLYGNMVYPAGEYEAVLITLGKGEGANWWCVLFPPLCFLDFSNGEAVKSPEDEQTAAGEDRREEKTDAADETVSGIDKDKEDKEVKFFLVEWITGLFS

SEQ ID NO: 7971 - protein, 394 aa, Bacillus licheniformis
MKKIFLFGCSFYFLVGVIHILLGSLSPYIIQEYQRDLHDLSFLIFFQFTGFLNGVLLAPMFVRRTSHTAVLTFGLLLILVTLLGVFLFDMFIFFVIMGFLLGFGAGTLETTMGAYVIAQDKNAKGMNILEVFFGLGALLFPFLIYILTERYAWHFPLYALFIFVFVLACMWVVYLRRKTPGTASGQMAYQEKPTVSAIFETGRKEKNIFLFLIFAFVYAGIETNFANFLPALMLEKGAEEISVISVTFFWTGMVCGRLLTSIFGGRITSVAFLIFSAGALTVLLLILAWFPVHQTQLLLVFFIGLSAAGIFPCAVTLASLAGKPFTEEITSLFISSASLGGALLSFLIGWAIDASAAAVFPFLLFGGLGGLLLAISAVIFLSGLQKNKQSHLDM

SEQ ID NO: 7972 - protein, 348 aa, Bacillus licheniformis
MKIGIIGAGGIAKAHAKALSTVKGAELSGFFDINSLASRKCAFEYGGTAFTSMQELLNQSTAVIVSSPNFCHKEHALEAMAAGKYVLCEKPMAVSMEEAEEMKSRASQSAYIPIMGFNYRHLTFVKRLKDMISGNELGDILSINVHFKKNSALRRKKYTWRDHSKSNKTSGALGDLGVHLIDLILYLFDSPFKLDSLKVKMMTVVKEKEQKQVYVDDHSEVYGQLENHVFVNMITSKCTKSDECGFSIEVNGQNGVFYYHSRQKNQFLLRAGLTEQMITMPDTWLTDPENEFYGWADSFRVQLIQWMNGIRDRNFASLATFEDGYKTQFYLNEFFNKGQQLSLSKQAN

SEQ ID NO: 7973 - protein, 282 aa, Bacillus licheniformis
MSYHETLSFHTLQQVNKPKYAVFCDFDETYFAHSITDESRKALMDLETFIHSHHLDHKILLGWVTGSSLSSVLAKMKRGGFRYLPHFVAGDLGTEITYFSEEGQVSDKDWEARLQESNFSHDLVEEIKQTLSKKYEIALVPQTQHGFSRYKINYYYKSLEESIDKRALEAIRRLAREHGIGVNINRCNPLAGDPENSYDVDFIPLRTGKPYIVDFILDKFAIERENSFAFGDSGNDVDMLKKTGHGYLVGNATAEAKSLHSRMTEGSYTAGILEVLKAHIKR

SEQ ID NO: 7974 - protein, 437 aa, Bacillus licheniformis
MKTANENMTCTSKQLFVLLNDLKEGKLAGECRIDDTLANQKLKETLQQDQFDITANLLNRMDSPPSRVDFMPLHRLITEEEVDDVVHAVKDVLPTGQFTSGFYVGVFEAEIAAFLSKKHVMASSSGTDAMIVALKAAGVGQGDEVIMPANSFAATENAVLAAGGTPIFCDIDPVTFCMDPSEIEACVTLKTKCILPVHLYGKLPDMEAIAKTADKYGIPIIEDACQAIGVSDLGKNSLCSILSFNPYKNLGTCGKAGAIVTDDPSFASACMEYMYHGFELNQKNKKAADYGFNAKIDNLQAAIGLARMKYLSLNNLKRLYLADRYIAHLQQYEDRGLIKLPQMTDDHVWHLFTIKILNGNRDQVKDMMLKFHNVQTDIYYPILSHHQNTPLVKANYRHTSLPVTESVHKQMLQLPLYPGLTVEEQDKVMEALIDVVS

SEQ ID NO: 7975 - protein, 329 aa, Bacillus licheniformis
MPTIDEIAKLSNVSKTTVSRVLNDHPYVSEEKRKRVLEVIEKLDYIPNTSARKLRSNKTMFLAVSVPHADHPFFAQLMKHMSAEALKHQYKVIVFQTFYQKQNELKVLELLKRKEVDGVMLCSLENEWEDIKKYVKYGPVVMANEFHAEADVPVICYDEFEAGYKGTELFIQKGHHLMAFCCDTIHSKAQIMRKEGFMKALSDAGLRFQEKWMFSHAFTIHDGFRIMDQIHNMSEKPTAIFTGNDQVAAGIIKRARYYQYEVPKQLAVLGYDNQSICEVTDPEITTIDIPVEELAQKAVCAMVNLLNGESGLQRDVVTLSPALKIRQSV

SEQ ID NO: 7976 - protein, 288 aa, Bacillus licheniformis
MKTIFEALRWASSYLTEAGRDRNAAEILLTDQLNIDRSKLLASFHDVISESDFARFKKSVELHHQGVPVQYITGKESFYGREFSVNEHVLIPRPETEEVVEAVLSEAERVFHGTDRLKAVDVGTGSGAIAVTLALESPRFSVTATDISEQALSTARHNADRLGAKVDFLCGDLLEPLIARQKKADVIVSNPPYISEEDMRTLSDVVRLHEPAGALTDGADGLQFYKRFMKEIPSVIADQALVVFEIGWTQGNAVKDMFHRFFPDADVRVKKDLNGKDRIVCAVIEQHS

SEQ ID NO: 7977 - protein, 356 aa, Bacillus licheniformis
MLDRLKSIEDRYEKLNELLSDPEVVNDPKKLREYSKEQSDLQETVEVYRRYRSASEQLSDAKAMLEEKLDSDMREMVKEEISELQEEIESLTDQLKVLLIPKDPNDDKNVIMEIRGAAGGEEAALFAGNLYRMYSRYAELQGWKTEVMEANMTGTGGYKEIIFMINGNGAYSRLKYENGAHRVQRVPETESGGRIHTSTATVACLPEAEEVEVDIHEKDIRVDTFASSGPGGQSVNTTMSAVRLTHLPTGVVVSCQDEKSQIKNKEKAMKVLRARIYDKFQQEAQAEYDQNRKSAVGTGDRSERIRTYNFPQNRVTDHRIGLTIQKLDQILEGKLDEVIDALIVEDQASKLQQAES

SEQ ID NO: 7978 - protein, 127 aa, Bacillus licheniformis
MLESIHHIAIICSDYEASKTFYVDKLGLEILSETYRKDQESYKLDLSLNGRYVIELFSFPDPPARLTRPEAAGLRHLAFTVADLDQTVKELKQKGITAEPIRTDPGTGKRYTFFSDPDGLPLELYEA

SEQ ID NO: 7979 - protein, 186 aa, Bacillus licheniformis
MNTADAANELGVSTKTVQRWVKQLQLPASRNELGHYFFTEDDIAILKEVKEQLKNGTPMQDVTVKRPKKTFFIKKNEMIQTKEPALQLNERLEERLQRFLEHEQLERELLQKKIAELERKLEQKADEVVSYQLLQQRRELEEERQQIKHLEQKISQLESMNRREKDTAVRREEKKPKSKLKSIFSF

SEQ ID NO: 7980 - protein, 318 aa, Bacillus licheniformis
MSFLNILILLAPIFFVIALGWFAGHFGSYDAKSAKGVSTLVTKYALPAHFVSSILSTPKDKFYSQIPLMISLVIGIVGFYVIILLLLRFLFKYDLTDASMFSLNSAQPTFAFMGIPVLGSLFGMQEVAIPIAITGIVVNAMLDPLAIIVGTVGRSSKKQTETTDSIWKVTGKSILHGLSEPLAFAPLASIILVLFGLQIPELPQKMLDMLGDTTSGIALFAVGVTVGIRKIKFSMPALSIALLKVAAQPALMFVIAMVVGLSSADMTKAVLLVAFPGSAVAAMIATNFESQEAETASAFVISAVLSIISLPILIAITA

SEQ ID NO: 7981 - protein, 567 aa, Bacillus licheniformis
MNNMRRTKEGHLETSLRGKDVLSIPTLNKGVAFSLEERKNLGLEGLLPPTVLSLDQQAERAYEQFSRQPDRLRQNVYLNDLQNRNEVLFYKLLQNHLREMLPVVYTPTVGEAIQEYSHEYRRPHGVYLSIDDMDGIETAFKNLQASADDIDLIVATDSESILGIGDWGVGGINIAIGKLAVYTAAAGIDPSRVIPVVLDVGTNNEKLLNDPLYIGNRHPRVEGERYEQFIDAYVETALKLFPNALLHWEDFGNKNARNIMSKYNHKIATFNDDIQGTGAITLAAILAAVKKTGTSLKDHRVVIFGPGSAGIGIADQIRDTMVLEGLSEEEANRAFWTVDYRGLLTTGMDQIMDFQEPYLRDTEEVKDWKRNEKGEISFEEVIRQVKPTILIGTSGVAGAFSEEIIKEMAAHTERPVILPMSNPTHLAEAVPEDLFKWTDGKALVATGSPFEAVEYNGVKHEIGQSNNAFVFPGLGLGTIVAKAKVITNGMFAASANAVANMVDHEKPGAGLLPKIDDLQDVSVQVAIDVVKAAIKDGVAQVQPEDVEKAVREAMWRPEYKTIVAKQD

SEQ ID NO: 7982 - protein, 194 aa, Bacillus licheniformis
MYIMKQSGWLELICGSMFSGKSEELIRRIKRATFAKQEVKVFKPAIDNRYSSESVVSHNGTSIVCHAIASPEEIFQYISKETDVIGVDEVQFFDETIVGTLTSLADQGYRVIAAGLDLDFRGEPFGVVPDLMALAETVTKLQAVCSVCGSPASRTQRLINGKPASYDDPVILVGASEAYEARCRHHHEVPGNPK

SEQ ID NO: 7983 - protein, 66 aa, Bacillus licheniformis
MKAGIHPEFKKATVKCACGNEFETGSVKEEVRVEICSECHPFYTGRQKFASADGRVDRFNKKYGLK

SEQ ID NO: 7984 - protein, 427 aa, Bacillus licheniformis
MKDVSISSLENMKLKELYELARHYKVSYYSKLTKKELIFAILKANAEQEDLLFMEGVLEIIQSEGFGFLRPINYSPSSEDIYISASQIRRFDLRNGDKVSGKVRPPKENERYYGLLHVEAVNGDDPESAKERVHFPALTPLYPDRQMVLETKPNHLSTRIMDMMAPVGFGQRGLIVAPPKAGKTMLLKEIANSITTNHPEAELIVLLIDERPEEVTDIERSVAGDVVSSTFDEVPENHIKVAELVLERAMRLVEHKKDVIILMDSITRLARAYNLVIPPSGRTLSGGIDPGAFHRPKRFFGAARNIEEGGSLTILATALVDTGSRMDDVIYEEFKGTGNMELHLDRSLAERRIFPAIDIRRSGTRKEELLVPKEHLDRLWSIRKTMSDTPDFVEKFMRKMKKTKTNQEFFDILIQEWKQANMSAARR

SEQ ID NO: 7985 - protein, 321 aa, Bacillus licheniformis
MERSLSMELVRVTEAAALKSARWMGRGKKDEADDAATSAMRDVFDTIPMKGTVVIGEGEMDEAPMLYIGEKLGNGYGPRVDVAVDPLEGTNIVASGGWNALAVIAVADHGNLLNAPDMYMDKIAVGPEAVGCIDIEAPVIDNLKAVAKAKNKDVEDVVATILNRPRHEKIIHELREAGARIKLINDGDVAGAINTAFDHTGVDILFGSGGAPEGVLSAVALKALGGEIHGKLLPQSEEELRRCEKMGLDTGKVLRMEDLVKGDDAIFAATGVTDGELLKGVQFKGSVGTTHSVVMRAKSGTVRFVDGRHSLKKKPNLVIRP

SEQ ID NO: 7986 - protein, 429 aa, Bacillus licheniformis
MEKLNIAGGDPLNGTVHISGAKNSAVALIPATILADSTVTLEGLPHISDILTLRDLLREIGGNVHFEKGEMVVDPAPMISMPLPNGKVKQLRASYYLMGAMLGRFKKAVIGLPGGCHLGPRPIDQHIKGFEALGAEVTNEQGAIYLRAEELKGARIYLDVVSVGATINIMLAAVLAKGRTVIENAAKEPEIIDVATLLTSMGAKIKGAGTDVIRIEGVESLHGCRHSIIPDRIEAGTFMIAAASMGQEVLIDNVIPTHLESLIAKLREMGVRIEESSEQILMVGGQKELKPVDLKTLVYPGFPTDLQQPMTSLLTKANGTSVVTDTIYSARFKHIDELRRMGASMKVEGRSAIITGPAPLQGAKVKASDLRAGACLVVAGLMAEGVTEITGLEHLDRGYSQLEEKLTKLGATVWREKLTDQEIEQLQNS

SEQ ID NO: 7987 - protein, 211 aa, Bacillus licheniformis
MLFFIDTANLDEIKEAHALGVLAGVTTNPSLVAKENISFHDRLREITEVVSGSVSAEVISLKAEEMIEEGKELAKIAPNITVKIPMTPDGLKAVKALTDLGIKTNVTLIFSANQALLAARAGATYVSPFLGRLDDIGHNGLDLISEIKQIFDVHGLDTQIIAASIRHAQHVTEAALRGAHIGTMPLKVIHQLTKHPLTDKGIEQFLADWNK

SEQ ID NO: 7988 - protein, 285 aa, Bacillus licheniformis
MPLVSMTEMLNKAKENGYAVGQFNLNNLEFTQAILQAAEEEKSPVILGVSEGAGRYMGGFKTVVAMVKALMEEYNVTVPVAIHLDHGSSFESCAKAIHAGFTSVMIDASHHPFEENVATTSKVVELAHFHGVSVEAELGTVGGQEDDVIADGVIYADPKECQELVERTGIDCLAPALGSVHGPYKGEPNLGFKEMEEIGNTTGLPLVLHGGTGIPTADIKKAISLGTAKINVNTENQIASAKAVRETLAAKPEEYDPRKYLGPAREAIKETVIGKMREFGSSNKA

SEQ ID NO: 7989 - protein, 124 aa, Bacillus licheniformis
MNEKILIVDDQYGIRVLLNEVFNKEGYKTFQAANGIQALDIVKNQRPDLVLLDMKIPGMDGIEILKRMKIIDEGIRVIIMTAYGELDMIQESKELGALTHFAKPFDIDEIRDAVKTYLPIKSNG

SEQ ID NO: 7990 - protein, 176 aa, Bacillus licheniformis
MLKIFTTQLTGIFNRIQEGEAQSIEDGARLLAQAVISDHSVYVYGKNELEGILKEAMYSSEPFPSVKPLQKDEENWPDFEMTDKVLMFCAGSADDEELKMAEKLYEKGIGLVVVSPSGKDGVPIASFADVHIDSKLRMPLLPDEDGTRYGFPSLMVSLYIYHALSFTLKEILQEYQ

SEQ ID NO: 7991 - protein, 503 aa, Bacillus licheniformis
MNVTIQKFDPYINVDPGTMSPYQHGEVFVTDDGAETDLDLGHYERFIDINLNKYSNVTTGKIYSTVLKKERRGDYLGGTVQVIPHITNEIKDRVFRAGKETHADVVITEIGGTVGDIESLPFLEAIRQIKSDVGRDNVMYIHCTLVPYLKAAGEMKTKPTQHSVKELRSLGIQPNVIVVRTEMPISQDMKDKIALFCDIDPKAVIEAGDADTLYSIPLDLQKQGLDSLVCSHLKLDCREADMEEWKELVKKVKNLSKTVTIALVGKYVELPDAYISVVESLRHAGYAFDADIQVKWINAEEVTEDNVADLVQNADGILVPGGFGDRGVEGKITTVKYAREQKIPFFGICLGMQVASIEYARNVLGLEGAHSAEIDPSTPYPIIDLLPEQKDIEDLGGTLRLGLYPCKLQEGSKAYQAYENEVVYERHRHRYEFNNEFRQQMEEAGFVFSGTSPDGRLVEIIELKDHPWFVASQFHPEFTSRPTRPQALFRDFVHASLKTSEKL

SEQ ID NO: 7992 - protein, 171 aa, Bacillus licheniformis
MSLKQYSEEQLKEMALVEIAYEIFSEHKKPITFQELTDQVASLLGMGKEELEDRIAQFYTDLNIDGRFLALSDQTWGLRSWYPYDQLDEETQPTVKAKKKKAKKAVEEDLDLDEFEEIDEDDILLDDVEEDLDIDADEFDEIDEADDDELDDLEDEILDDDEDFDEEEDEE

SEQ ID NO: 7993 - protein, 379 aa, Bacillus licheniformis
MIFKLSEEHQMIQKMVRDFAHHEVEPTAKERDEEERFDMELFAKMAELGLTGIPWPEEYGGIGSDYLAYVIAVEELSKVCASTGVTLSAHTSLAGWPIYAFGTEEQKQEYLKPMARGEKIGAYGLTEPGSGSDAGGMKTTAEKKGDEYILNGTKIFITNGGIADFYIVFANLAPEQKHKGTTAFIVEKDFPGFSVGKKERKLGIRSSPTTEIIFQDCRVPLKNRLGGEGEGFKIAMKTLDGGRNGIAAQAVGIAQGAFEAAKAYAKERKQFGRPIAEQQGIAFKLADMATEIEASRLLTYQAAWLESEGLPYGKASAMSKLYAGDTAMKVTTEAVQIFGGYGYTKDYPVERFMRDAKITQIYEGTQEIQKLVISRMLMK

SEQ ID NO: 7994 - protein, 376 aa, Bacillus licheniformis
MNFQFTEEQTRMQKVVRDFVKQEVAPFVPEMEKGRFPTSLLKKMAERGWMGLPIPAKYNGAGHDFITYMMTIHELSKKSAVLGAVLSVHTSIVTIPILLNGNERQKEHYVKKLAAGQYLGAFCLTEPSAGSDAGSLKTRAEKRGDTYVLNGTKVFITNGGAADIYLVFASTDPEAGTGGISAFIVEKGTPGFFIGKNEEKMGLHGSLTVTLNFDNAVIPARQLLGEEGMGFKMALSNLDTGRIGIAAQALGIAEGALSEAVQFLKKRYPDGELYKNGQALAFKLADMAARTEAARLLVYQAASLKQQGMQTGKAASMAKLFASETAMYVAGEAVQLLGDFGYTKDFSAERYFRDAKVCEIYEGTSEIQRIVIGKHL

SEQ ID NO: 7995 - protein, 287 aa, Bacillus licheniformis
MKKDTIMVIGAGQMGSGIAQVSAQAGYNVYMYDVSPEQIEKGMKRISGQLFRQAEKGKLPHEDVKQIYQRLSPSAALDEAREAFLIIEAAVEQMDVKKDIFTRLDEVTEDSAILASNTSSLSITELAAVTKKPQNVIGMHFMNPVPVMQLVEVIRGLETSGETYETVVAAAERMNKVPIEVRDFPGFISNRILMPMINEAVFALYEGIAEKESIDGIMKLGMNHPMGPLALADLIGLDTCLYIMETLHEGFGDDKYRPCPLLKQYVSAGRLGKKTGRGFYTYEKQPT

SEQ ID NO: 7996 - protein, 392 aa, Bacillus licheniformis
MARSVIAGGARTPFGKLGGALQSKTAAELGGIAVKEALKRSGVNPEDVDEVIMGSVLQGGQGQLPSRQAARFAGLPWDVKTETINKVCASGLRSVTMADQIIRAGDAEVIAAGGMESMSNAPYLLQKARWGLRMGDGAVKDLMIADGLTCSFTGVHMGSYGNAAAKELEIAREEQDRWALRSHMRAVHAADSGALGEEIVPVSIQEKRDGELTVDQDEAPRRDTSMERLSKLAPVFDHNGTITAGNAPGVNDGACSLIVMNEDKAKELNVKAPAVIKAHTSIAVEAKDFPKTPGLVIRELLNKTGAELSDIKLFEINEAFAAVALASGKIAGLDMEKVNVNGGAIAIGHPIGASGARIILTLMYELKRRGGGIGIAAICSGGGQGDAVMIEV

SEQ ID NO: 7997 - protein, 704 aa, Bacillus licheniformis
MNVLLSLNFIAFLGVTVYAVYLFVYLIRTRISYIRLGQKEDFDKRTKERLQKIWENVFGQKKLLKDKKSGIIHVMFFYGFILVQFGAIDFILKGLVPDQGIPLGGVYPAFTFFQEIVTLMILIAVVWAFHRRYIEKLVRLKRNFKSGIVLMLIGGLMFTVLLGNGMNMIWHEHSLSWHEPMASGIAFAFGFMGETASAAVFYAAWWAHLLILLTFLVYVPQSKHAHLIAGPANVFFSRLTNPGKLQKIDFEDETKETFGVGRIEEFRQSQLIDLYACVECGRCTNMCPATGTGKMLSPMDLILRLRDHLTEKGAAVTSRTPWVPAPLFQHTKGNQLAMAAGGEGSREAAASELYNPSLIGDIITEEEIWACTTCRNCEDQCPVMNEHVDKIIDLRRYLVLTEGKMDADAQRAMTSIERQGNPWGLNRKERENWRDIRDDVEVPTVKEMKKKGESFEYLFWVGSMGSYDRRSQKIAMAFARLLNQAGVTFAILGNKEKNSGDTPRRLGNEFLFQELAAKNIEEFEKNDVQKIVTIDPHAYNIFKNEYPDFGLKAEVYHHTEILAALIEEGKLKPEFPVHETVTFHDSCYLGRYNEVYDPPRAILRSIPGIRLAEMERSRENGMCCGAGGGLMWMEEEAGARINVARTEQALSTSPSVISSGCPYCLTMLGDGTKAKELEDQVGTYDVAELLERAVFGSEQKEHAS

SEQ ID NO: 7998 - protein, 396 aa, Bacillus licheniformis
MVPLMIMVCFLILLLALDFHFGRKAFEKKAYEPVFSEKKSDIELIHNGEDLCERLLDDIRQAESSVHVMFYIVKNDDISLEFLKVLKDKAKSGVCVRLLIDRIGAMKVKKKTLSGLKQSGVHVFFANKPGFPYFFYRLNARNHRKIAVIDGKIGYVGGFNIAKEYLGKKAEFGPWKDYHLRMTGEGVADLQHIFISDFKREAPQAKPANSVFPPLQQGAVTHTTHATKGFSLEEKYISFIEQAKERIMICTPYYIPSPALQQAVLSARERGVIVSVLVPMKPDHPLVKEAAYTHFPALLKAGCYIYRYYRGFYHAKALIVDDRHVMIGTSNFDNRSLFLNDEVNVVIHDKDWTKQFFDVVKESIEHAELLTKERYAKRPVMQRPVEWLAKSISFFL

SEQ ID NO: 7999 - protein, 88 aa, Bacillus licheniformis
MNQAESIKLRAQSMTLKNLIELYKLCRSARHQLYICSRKTMCKIKDLIELEMFRMANRENECLIVIEGKMAQELVKKAQSILSDAQVQ

SEQ ID NO: 8000 - protein, 556 aa, Bacillus licheniformis
MNIVEQMKDVLKQEIKEAVMKAGLAEESEIPEVVLEVPKDKSHGDYSTNMAMQLARIAKKAPRNIAEEIVASFDKGKASIDKLDIAGPGFINFYMNNQYLTKLIPAVLEAGEAYGETNIGGGERVQVEFVSANPTGNLHLGHARGAAVGDSLCNVLEKAGYEVSREYYINDAGNQINNLALSVEARYFQALGKDKPMPEDGYHGEDIKEIGQKLADEFGDRFVHEEESERLAFFREYGLKYELGKLREDLENFRVPFDVWYSETSLYQNGKIDQALEALREKGHIYEEDGATWFRSTAFGDDKDRVLIKKDGSYTYLLPDIAYHKDKLDRGFQKLINVWGADHHGYIPRMKAAIEALGYDKETLEVEIIQLVHLYKNGEKMKMSKRTGKAVTMRDLIDEVGLDAVRYFFAMRSADTHMDFDLDLAVSTSNENPVYYAQYAHARICSMLRQGEEKGISFEGNLDLTKIGSEKEYDLLKVIGSFPEAVADAAEKRIPHRITNYIFELASVLHSFYNAEKVLDPADEEKSRARLSLMKATQITLNNALKLIGVSAPEKM

SEQ ID NO: 8001 - protein, 142 aa, Bacillus licheniformis
MDQETPVHIYVKSVIREGSDTETIEFRTTGFYYMKKDKIYLSYHEEHDAGKVKSIVKASENEVLVMRSGAIEMKQRFRPGSRTVTHYKMPFGRLELGVDTKAVSVTHQPPDGKISIEYDMIVSDEQKHLHKMSISYRGGHES

SEQ ID NO: 8002 - protein, 290 aa, Bacillus licheniformis
MRFDEAYSGKVFIASRPDWEEADAILYGMPMDWTVSYRPGSRFGPARIREVSIGLEEYSPYLDRELEEVHFFDAGDIPLPFGNPQKSLDMIEEYVDSILDKGKFPLGMGGEHLVSWPVIKAMYKKYPDLAIIHMDAHTDLRVDYEGEPLSHSTPIRKAAELIGPGNVYSFGIRSGMKEEFEWAKENGMHISKFEVLEPLKAVLPKLAGRPVYVTIDIDVLDPAHAPGTGTVDAGGITSKELLASIHEIARSDVNVVGGDLVEVAPVYDHSEQTANTASKLIREMLLGWVK

SEQ ID NO: 8003 - protein, 276 aa, Bacillus licheniformis
MSGLWYTEKQTKNFGITMKINRTLHTEQTDFQKLEMAETEEFGNMLFLDGMVMTSEKDEFVYHEMVAHVPLFTHPNPEHVLVVGGGDGGVIREILKHPSVKKATLVDIDGKVIEYSKKFLPSIAGKLDDPRVEVKVDDGFMHIAQSENEYDVIMVDSTEPVGPAVNLFTKGFYAGIAKALKEDGIFVAQTDNPWFTPELITNVQRDVKEIFPITKLYLANIPTYPSGLWTFTIGSKKYDPLEVEDSRFFDIETKYYTKEIHKAAFVLPKFVSDLIK

SEQ ID NO: 8004 - protein, 163 aa, Bacillus licheniformis
MRRSAGAIATNRTVLPLILLGCTVSAFVMICLLFWSAAIGWFTFGGYGAENVHPFFELSGSPLWFVVSRLFIDWWSLCFLIFLGLAGVLIAKKEQLALWLPLAWSSGLMLLFKFNISFKGLLPGEGMLLSIHAAGASPILAASVSEGAVFVLWLISYVATAKK

SEQ ID NO: 8005 - protein, 691 aa, Bacillus licheniformis
MDIMTDKRVRLTIKTIRAFLFMGALMLIFLSIVVMTVVLAAKWQGAPSIQVPRSTVLYDGSGKQMGETHYGQKRYWVSLKNINPAVIDATLAVEDRNFFRHHGFDYMRMGGALIADLKAMSKVQGASTITQQYARNLYLGHDKTWKRKWNEAFYTIRLEQNYTKKDILEGYLNTIYYGHGAYGIEAASRLYFGKRAKDINTAEAAMLAGIPKGPSVYSPFVNEKKAKERQEMILTMMEKQNKLTEMQAAALKKMPLRFEKQDKQTTEKTAPYFYDEAVKEISRLLRLTPEQAETGGYNVFTTLNPRLQKIAEDTIEHTIDSSSDIQAGFAAINPSDGSVLALVGGRDYEKSPFNRVTQAMRQPGSTMKPFLYYSAVQNGFTPATRMRSAETTFELGQGSAYSPSNYHGYYADGPITLLQALALSDNIYAVKTHLFLGMDKLIDAAKQFGINSPLQKVPSLALGTSPVKPIEMVNGYAMFANGGKKIEPSFITKITDPNGKVLYEKPKRSKQILDPKAAFITANMMSGMFDKSLNGYTSVTGRTIADQLTRRYAGKSGTTSTDSWMIGFYPGLASGVWTGYDKERTIDAVAEKNYAKQIWAEFMEKALEDAPAAALMPPEGVKGMYIDPATGYAAAPSCPSKYFAYFIKGTEPEQVCYGKEIYKEQNAGHEKPAAPPHKRQKWWEKWFKKGE

SEQ ID NO: 8006 - protein, 171 aa, Bacillus licheniformis
MEQGKKKKTIGFNIIKSDPTDGHGGFGAGALSLDNISPVIVDVEEKEAFVDIGAMHARSTVEKGIKFLPNKEEVPNGKPYWLVWVTIDRREEGPYYAGVTACEMTVDRSIRRGYKSLPEHVNLMDKSMKRKIIVEHMDEGSKRVLADFLKNHDQGLWDRSSDELKKGLLQQ

SEQ ID NO: 8007 - protein, 229 aa, Bacillus licheniformis
MYMRKRESHILDRFLIYPLEMIPYVVLTLAAAFTVHEVAHAYVAYKFGDETAKRQGRLTLNPLKHLDPFGTILIFILGFGWAKPVPVNRFYFKNPRLAGFLVSIAGPISNLILAFIGFILLLLSVKLSGTLPAGFYSGLLQFFTIWVNLNLLLFLFNLMPFPPLDGFRVIQDVVAPEVRAKLSKYEAYGSIVFLIIVITPLGQYVFWPFLNDGRELIISIFNSVFRPLM

SEQ ID NO: 8008 - protein, 61 aa, Bacillus licheniformis
MPYVTVQMLEGRTDEQKRNLVKKVTEAVSETTGAPAEKIAVIIEEMKKENYGVAGKRMSDM

SEQ ID NO: 8009 - protein, 268 aa, Bacillus licheniformis
MKKRSLFLSLLLSVSLIPGVTAGAAKTGGHEHEHDHEARGTYIDSLPKAKDFKDLKGKVQIERTVNTKILDEKGNVTGTKTFKKNTGKGSFSTQAGTGSQKVSVLAVADAQYRAKYSDWQTRIVQIIEQADVMFNRDHDVDFVVEAVAPWTSSGSNSSQILSNLQSNFSGRSYKFVVGFTANSNFDAGGIAYVYNSKPNGSAFSVNLDQGTANTAKAATHEFSHNFGLNHDAQGSGIRCIMNYDYAYTVDVWDSAHNSQITKNKAWYK

SEQ ID NO: 8010 - protein, 167 aa, Bacillus licheniformis
MLKEHAKLMKVFSDSGEIVGRKKLQKIIYIAKKLELPFYEKYDFHFYGPYSEELTLQVEELCNLGFLHEVKEKKGGYYQYRYSPTEAGKQFLSQCELDMRDIKAYLDDVNGQSSRFLELVSTILYFEGLEQEEIREKVFTVKSKQRYTDEEFDEAVAYIKKLRNLCS

SEQ ID NO: 8011 - protein, 432 aa, Bacillus licheniformis
MAYPNGKLSEEKVFKDPVHRYVHVRDKLIWDLIGTREFQRLRRIKQLGTTYLTFHGAEHSRFNHSLGVYEIVRRMVDDVFKGREEWDDSERDLCLCAALLHDLGHGPFSHSFEKVFRLDHEDFTRAIILGDTEVNRVLNKVSPTFAKDVAEVIAKTYQNKQVVSLISSQIDADRMDYLQRDAYYTGVSYGHFDMERILRVMRPREDQIVIKQSGMHAVEDYIMSRYQMYWQVYFHPVTRSAEVILTKILHRAKQLHEEGYVFTHAPVHFYSIFEGNVTLEDYLSLDESIILYYFQAWEKEEDEILSDLCRRFINRRLFQYAEFNPNEEMATYFELTNLFKESGIDPEYYLVVDSSSDLPYDFYRPGEEEERLPIQLLTHNGQIKELSRQSDIVDAISGKRRTDHKLYFPLDLIEGLPDGRHAKRMKELLGLK

SEQ ID NO: 8012 - protein, 74 aa, Bacillus licheniformis
MANEFRVCDDCQATNLKTLLPRLKEIDPDAKVEIGCQSYCGPGRKKSFAFVNNRPLSAPDEDELIEKVKKKLKK

SEQ ID NO: 8013 - protein, 261 aa, Bacillus licheniformis
MKQRQDAWSEENDLLLAETVLRHVREGSTQLNAFEEVGDRLNRTSAACGFRWNAVVRHQYEKALQLAKKQRKQRMRALGNGQPAKKRLLYKPPVETNAEPPAESVVEQKKATADSSEQQPIASEHLPYVDESFKEELASLSHLLSPNQPQAGHTADTSKDMTIDDVIRFLQNYTGNEEQTAALKMENERLKQENEELTKKVEKLEAEVKKLEKDQTTIQEDYETLVKIMNRARKLVLFEEDEHAAPAFKMDRNGNLEKMAE

SEQ ID NO: 8014 - protein, 109 aa, Bacillus licheniformis
MKFVLYAVQFGTAALLFLFSALASWYQGSELLKVPWEWKYTAKFTSWLYGEDSIKNAHNISQLDFFVYAAKHTPATVILMAVSLAYIIALAAYLLIKTYVKRKSASSAA

SEQ ID NO: 8015 - protein, 281 aa, Bacillus licheniformis
MAKQPIDLLIQPKWRIIDQSSLGPYFDAKQSFAIDDTLCASVGKGLSPATARSWVHHDTIVLGIQDTRLPYLQEGISLLEEAGYQAIVRNSGGLAVVLDSGVLNVSLIFQDKKNGIDIDRGYEAMFELVKRMLSSYDAAIEAYEIKGSYCPGSFDLSIGGRKFAGISQRRLRGGVAVQIYLCADQSGSGRAELIKRFYDTALKDMRGKTKAVYPDIRPETMASLSELLNEDISVQDLMLLLLTQLKELGGEIYQGPLTPAEEEVYEKNLVRMIERNEKVFG

SEQ ID NO: 8016 - protein, 401 aa, Bacillus licheniformis
MRTQVGIIGAGPAGLMLANLLHRRGIEAVVIESRSRKEIEETVRAGVLEQMTVDLLNETGAGERMMKTAMFHQGIEIRFGGKRHRIDMHKLTGGKYIAIYPQHEVIKDLIAARLQSEGRIVFNVSDVRLSNIDTEAPVITYQNENGDTEELNCDFIAGCDGFHGPSRQSIPKEIRKEYEKVYPYGWLGILAEAPPSSPELVYAHHEDGFALVSTRTPEIQRLYLQVSPADSVGNWPDERIWEKLHLRLSADDGWKLTEGPIIQKNIVSMRSFICDPMQYGRLYLAGDAAHIVPPTGAKGLNLAMADVQRLAWALEDYYETGRIERLAGYSESCLRRVWKAERFSWYMTSLLHRHHGYTPFDYQIQLAELDHVTTSTAAAQSLAENYVGLPLEFGEPSLSVT

SEQ ID NO: 8017 - protein, 458 aa, Bacillus licheniformis
MKNRSVHPAEVMAASKFNKVHLTVFLWCFFAIAFDGYDIAMYGVSLPWLMEEWSLTAIQAGAIGSYTLIGMMLGALIFSPIADQYGRKKVLGFCIFLFSLFTAAAGLIDSPLLFTIMRFLAALGMGGLMPNAISLMTEYSPKKNRAVIVAAMYCGYSAGGVLASLVGMFAVPVTSWRVLYLIGAVPLFVLPFFFSRFPESLSFYVLKKKTKALAEIFNQVHPAGRYREDDNYQISVIAKEKKGFPVKKLFGQKRAASTFAFWLSVFSCLLMVYGLNTWLPKMMQASGYGLSSSLSFNLALCCGQAAGAVFGGYLADKAGHKNVLAAMYVIGAFCFAAFGMTMNPVLLYLLIALGGACTVGAQNIANPYISEYYPKEIRATGIGWALGVGRLGAIIAPSLFALILASGMEPKQAFMVFAIPSVFAALGIMLVQEKHASFDFVSKSESAGYTLEATSKHG

SEQ ID NO: 8018 - protein, 283 aa, Bacillus licheniformis
MSIELAALVPHTPRMCFEDKTPDFQRELVKGMKRLSRIIERIEPDAVVLISCHWTSSFDHLIDAAPDHQGVLTALECPNLISDVPYSYPGDTELALQLAEAGREGGLSVIPVNDPAYCWDYGTVVPLRYLVPKGDIPVIDLSVTLAANLEETHLWGRLAGRVLKESRKKTVFISSGALSHHLVRGPECMPTLAEQALDAQFLTYLTDNDLLSAQQMLPQYAKNAGLEAGGRHIAMLLGVLEDGCKSTFYGYGQSSGSSNVVMAFEPAGQKARTHAFNEKDTVR

SEQ ID NO: 8019 - protein, 63 aa, Bacillus licheniformis
MPIVHIQLLEGRPPEKVEEVIRKVTETLSATLDSPKENVRVLVTEVSKSHWGIGGTPVSKLRP

SEQ ID NO: 8020 - protein, 261 aa, Bacillus licheniformis
MNTAALKDTARLLYLAETEKREVERITKDYPELTVEEAYAIQEELIQLKLWDGNSIIGPKMGLTSRAKMKQMNVEEPIYGYIFEDMIVPNGGSIRMNELIHPKVEAEIAFVLGEDIEGPGVTKEQVLEAVAELIPVLEVIDSRYENFSFTLPDVIADNASSSRVVLGEKVKKPDDFKLDEARVSLMINGEVKERGTGAAVVGHPANSAAMLANMLSRKKQKLAAGSIILTGGVTGAVMLQPGDRVSAQVEGLGDVSFSVKP

SEQ ID NO: 8021 - protein, 491 aa, Bacillus licheniformis
MNVQTPSEKLVKPFDCQHYINGRYFPSEKGSTFDNINPATQEIIGSVAEGGKKEVDLAVAAARRALNGRWKNMTADERIRIIRKVGDIILERKDELARLETLDTGKPLSLSSTLDIPRAAFNFHFFADFMRGAGTEAYQTDDLAINYAIRRPVGVVGLINPWNLPLLLLTWKLAPCLAAGNTAVIKPAELTPMTATLLGEICHDAGMPDGVVNIVHGFGPDSAGAALSEHPDVDAISFTGETTTGKVIMEAASKTLKKLSFELGGKNPNIIFADADMDEAVSTSLKSSFVNQGEVCMSGSRIYVEREAYDEFLNKFVEKTKKLKVGDPFDPDTNIGALISSEHTERVMNYIELAKREGGNILTGGKRHEGQESGCFLEPTIITGLSRNSRLIKEEIFGPVVTVIPFDDEEEVIAQANDTHYGLSATLWTNDLRRAHRVAGQIESGMVWVNSWFLRDLRTPFGGMKQSGLGREGGIHSLEFFSELTNICIKL

SEQ ID NO: 8022 - protein, 259 aa, Bacillus licheniformis
MTVETKDHQLLGSVKNALRLLQSFTLDTPEKKLTELASSLGLGKSTVSRLLSTLESEGFVMKDPESRRYKLGLSVLQLNTIVNSTLEINRESLPVLKRLTDETGETSHIAMRRGLSVVYLNRTECPRPVELLSYIGRQNPMHCTSSGKVLLAFDEEGILDEYVKEGLKSCTKETITDGDKLRDVLKTVKENGFDVSCGEFIDGVTSISAPVRNHAGRVLYAVSVVGPAKRIKARQAKIIYQVKQAARDISERIGYWKRI

SEQ ID NO: 8023 - protein, 316 aa, Bacillus licheniformis
MYDLHTHFIPRDVLLWLEDNEKRVHAVREKKAGCQAEFLTVNHKWGFELKELFYQEALYLEAQQEAGVTHSLVSPVPQLFLYDLAEEITDELSFVYNKALAEWVKKYDGRLSGLGTVPLNSPSKASERLNEAMNNGLKGAIIGPGASQLLLSDEAFTPFWETADRRKAIIFIHPLLSEDPRLRRRMLPNLIGVPWETTICAADLLLSGFTDRFRNVKILLAHGGGFLPYQIGRLNKGYDKWAGVSSSLSAPPREYLRKFWFDGVLWEQESAAYLKKLVGEDRLVPGSDFPFDLCQWPPLDPGRKGAESLLNVAIEA

SEQ ID NO: 8024 - protein, 323 aa, Bacillus licheniformis
MADLFTTVQGKVAGKGVKIVFPEGLDERILTAVNKLAGNNVLKPILVGNEQEIKDKANGLNLTLDGVDIYDPHTYEGMEDLVQAFVERRKGKATEEQARQILLDENYFGTMLVYKGLADGLVSGAAHSTADTVRPALQIIKTKEGVKKTSGVFIMARGDEQYVFADCAINIAPDSQDLAEIAIESANTAKMFDIEPRVAMLSFSTKGSAKSDETEKVANAVAIAKEKAPELTLDGEFQFDAAFVPSVAEKKAPDSVIKGDANVFVFPSLEAGNIGYKIAQRLGNFEAVGPILQGLNMPVNDLSRGCNAEDVYNLALITAAQAL

SEQ ID NO: 8025 - protein, 254 aa, Bacillus licheniformis
MSEQQKTNEAAQTLDGWYALHDFRTMDWSAWKMLSSDERQIIISEFTGLLEKWGAAQKEGNGSHTLYSIVGQKADFMLMILRPTMEELNQIELEFNKSKLAEYTIPAYSYVSVVELSNYMGSGDGDPYENPQVRARLYPELPDAKYVCFYPMDKRRSGDDNWYMLSMEERRNLMRSHGMIGRGYAGKVKQIITGSIGFDDYEWGVTLFSDDVLQFKKLVYEMRFDEVSARYGEFGSFFVGNRLAKEQLPAFLHV

SEQ ID NO: 8026 - protein, 179 aa, Bacillus licheniformis
MKRMYRSKLSILAVSLVMMASIFLPSFQASAQTTKTESVYRPAASASLYSVITGASKQEWSFSDIELTYRPNSILALGTVEFTLPSGFSATTKDTVNGRALTTGQILNNGKTVRLPLTIDLLGIAEFKLVLANKTLPAAGKYTFRAENRVLGLGSTFYAESSIEVQKRATPPTQPCNCK

SEQ ID NO: 8027 - protein, 448 aa, Bacillus licheniformis
MPKLVSSNLVKGKIINISPPQTLALSFLIIIAIGACLLKLPGASTTYISWVDALFTATSATTVTGLVVVDTGADFTVFGQTVIMCLIQIGGLGLMTFAVLVVMMIGKKIGLQQRILVQEAFNQTSLGGLVRLVKHLFIFTIVIEFVAFLILSIRWVPEYGLQKGLFHSLFNTISAFNNAGFSLWPDNLSQYVGDPIVNLVITGLFITGGIGFTVLLDLWTKRNFRKLSLHSKLMIVGTLIINTTAALLIFILEYSNPGTLGGLPLADKMWGAYFQGVTPRTAGFNTLDIAQMTTPSLLLIIVLMFIGAGSASTGSGIKLTTYIVMILATITFLRGKSETVVFKRAIKMKTILRALAIIVISFLFVLFALFILTITENAPFLKIVFEVFSAFGTVGLSMGLTPDLTAAGKAVIMMMMFIGRVGPLTMAFTLAKPKKAPIRHPEDEVITG

SEQ ID NO: 8028 - protein, 178 aa, Bacillus licheniformis
MKFKKNQFQPLQELEMPDFRQQMGPNPYPQMGQMGQMYQQQGQQPFTQMGGQQSYQQPGPQLTQPQPAGVQVPPMPSGQQPSPSIPGMLPLEQSYIENILRLNRGKVATVYMTFENNPEWNAKVFRGEIEAAGRDHIILSDRKTGTRYLLLMVYLDYITFDEPITYDYPYSMASYTPR

SEQ ID NO: 8029 - protein, 381 aa, Bacillus licheniformis
MKEMLWLVKNTLNVTFKKKINIFLFVCLPLLGIFVSLLTEGSMEKTDLRVGIINHDGGRIAEDTKDFLKGIENVNISAVSEAEGKSQVAAGELDCVITFEQGFSQSVQSGEPAHIAIASVKGAEITGFVKSYVYHYIDNIAAIGKSAQGNEKRFEEMYKNYRNSETSVKTSTIEDTAKNRNMTERTVGFLLMAMLFSAGSLTELLVKEKENRTYFRLLTTPITARQYVMSNVAVSMSVITCQTFLTLIMVKYVFRMETGISFWEMAAVLLIFALSAVGLALITVVFANSSRSSGVLRNLIFMPTIMLSGCFWPVEIMPSFAQRIADFLPQRWVLDTLAKLQEGQQLQGLYLNIMILFAFAAVFFLIVIYKFKRNNDVRNFA

SEQ ID NO: 8030 - protein, 373 aa, Bacillus licheniformis
MNTLIIAKKEIVSAFRDKRTFLFMLAFPIVLIMILGTALTNAFDQQAAVGEVRVLYKDNSDGAFSQGFKTFVKEAKTSGVHFKKVLSDMDEKQEIKQGNYDAYLEIENSGIKLYQMDKNSMKNSIIQGMLTAFANRYNAAAEIIKAAPEQAGAVLGDAPGDNYIKETSLSSDRKPSSMDYYAVAMTTLIALYSALSASYLIRGERLRKTADRLIAAPVHKGEIFAGKLIGNLVTNGLCIFAVVAVSKYVFKAYWGEHLGLVAAVLFSIVLFAVCLGLGVSYLTRTGEAAVAIINVLIPLVAFFGGAYFPVDDAEGVLALITDLSPLAWTNEAIMNIIFADDLAAGLPAILLNIGLSLLFLLIAVVSLQRREGL

SEQ ID NO: 8031 - protein, 311 aa, Bacillus licheniformis
MNVLEIHHLTKKFGDFVAVDNISLSIEEGEIFGLLGANGAGKSTTIHMISSLLRSNEGEITILGKNIAKHRKFAKMNIGIVPQDLAIYEDLTAYANVKFFAGLYGLRGAHLHNRVEEALQFVGLSDKHKSFPKNFSGGMKRRLNIACAIAHRPKLIIMDEPTVGIDPHSRNYILESVKKLNAMGCTIIYTSHYMEEVEEICTRIAIVDHGKIIAEGTKEQLKSIITNTKDIQVVLKSAENIDIGELKTISGVEAAVLEDNTIKINSDAGVNNLNQIIEKLMKNGAEIRSLEEKAPNLETVFLTLTGRQLRD

SEQ ID NO: 8032 - protein, 368 aa, Bacillus licheniformis
MELRIMTGKLILLGFIIYQCVFSESDNLPWLVFSLLVYVCINLGIAILPKGKTKKLFIIISVIISIVSYAEVHPLFILFLPFTLCEGAADFGLPKWAVLAASIVPVLFINESISAVYALTAAFQFLLYWAASHDAARIEKLEHHIDQTRRDLQKLTNMLRENKEFIRQSEYTYKLEERNRLSQEIHDKIGHSMTGALIQLEAAKRVLDIDKEKASELLQNAINISKDGIENIRLTLKSVKPPSEQMGIHRLRLFIDECSAQYHMNISFLHKGDLDVISQIQWKIIFENITEALTNSVKYAEATHVSICIHVLNTLIKAEVKDNGKGRQKIKKGMGIIGMEERAASVNGKVIVDGSNGFSVTTLLPKHE

SEQ ID NO: 8033 - protein, 230 aa, Bacillus licheniformis
MHFDRRDVHGGGPVSVQTMKIKVIIADDNSFIREGMKIILSTYDEFEVLATVEDGLQAVEFCRAQAVDIALLDVRMPNMDGVEAARLISETGAKPFILTTFDDDEYIVAAIRNGAKGYLLKNAEPERIRDAIKSVFNGHIVMQDIILDKIKSNLAEHKEAEPKIDESLFTERELGIMALIARGLSNKEISKELFISEGTIANYISSILGKTGLEHRTQIAIYYLTGKVNF

SEQ ID NO: 8034 - protein, 123 aa, Bacillus licheniformis
MKLFLILGAVNAMLAVALGAFGAHGLEGKIPEKYLQIWQTGVQYHMYHALGLIAVALIASKLAGAGSVSAAGWLMFAGIVLFSGSLYVLSLTQISVLGAITPLGGVAFIAAWIMVVVSAVKYL

SEQ ID NO: 8035 - protein, 433 aa, Bacillus licheniformis
MKLLFGALQWTAFIIASAIVVPIAIGQSFGLNQGETAGLVQSTFFVLGTTAFIQCLLGHRLPINESPAGLWWGVYTIYAGLTGTVFATHIETLQGLQGAMLLSAVFFFIFSLFKVIDKLAVMFTPVVTGIYLLLLVIQLSDPIVKGVMGIGYRKNEVDIPVFLLAVVIMLATFLMSRSNVPILKQYSILIALFGGWILFAVFGVAKAPERANQLFHLPDIFPFGMPMFDSGLVVTSLFITVLLIVNMLASIRVVEGAVKQFEKLEERKRARPAGFIASVSHLLSGLLGAVGTVPISGAAGFIQTTRMSSKKPFLLGSLIVIVISFFPLVMNTFASLPSPVGFAVNFVVFSTMVGLAFAEFDSYEKDEAGRIRFVTGIALLAGVGVMFVPESALEGMHPVFVSILSNGLVLGTIVAIAAEQIQLRKKKYDNIVS

SEQ ID NO: 8036 - protein, 115 aa, Bacillus licheniformis
MKWKLKTVWRIDLMNIHISSLLQKMEDELKKAKECHQENELKMHIAVIRSLCDVIVEPQQGPSVQSSPYVQTANKPSSDQLMLEKMMGSAGAEQYKKQEKQKHEDDGNGDSIFDF

SEQ ID NO: 8037 - protein, 460 aa, Bacillus licheniformis
MAERTTSIETTVTEQKQYFLSGATLAVENRLEQLNILKDAVKKNERNILEALQKDLNKSEHEAYMTEIGIVLEEIRFISRRLKKWAKPKKAKTAVSHIGSKSIVIPEPYGTVLIIAPWNYPFQLAVSPLIGALAAGNTAVIKPSELAPAVSTVISEMIKDIFPPEYVSVIEGGVKTNQELLRQKFDYIFFTGSVPVGKVVMEAAAKQLIPVTLELGGKSPCIVHKDADLKLAAQRIVFGKLTNAGQTCIAPDYLLVHKDVKNELMRALKQSIQTFYGEKPESHLAYGKIISKRHFERLIRFLQNENIVTGGTYQKDALKIAPSIIDEPDWESPVMQEEIFGPILPVIGYETIEDVIQMVQSRPKPLALYLFTNEKTVQRHILSRISFGGGCINDTLMHTATPYLPFGGVGESGIGSYHGYHSFKTFSHEKSVLKQTNLFDISFRYPSSKNGLRIIKKLLR

SEQ ID NO: 8038 - protein, 225 aa, Bacillus licheniformis
MKQILNDSWWQQLKDEFDKPYYQELREMLKREYAEHTVYPEPNDIYNALHYTSYENVKVVILGQDPYHGPGQAHGLSFSVQPGVNPPPSLKNIFIELQNDIGADIPNHGSLVSWAKQGVLLLNTVLTVRRGQANSHKGKGWEQLTDSIIDVLNKRDKPVVFILWGRHAQMKKERIDTSKHFIIQSPHPSPFSARNGFFGSRPFSRANQYLEQIGDEPIDWSLPNL

SEQ ID NO: 8039 - protein, 272 aa, Bacillus licheniformis
MNISIVVVTHNRVTALCELLESIAKQSVEPFEVIIVNDAGESVDFVERLYSELPIRVIHLKENVKHVKARNIGVKEASGDVIMLCDDDDFFTPCHMERMLNALETADFVYSDAEIVSFEEKEDMRIPTSRYLFAYSFNLDEMRKFSTYVPSGSMYKRSLHDEIGYFDPAVHNYWDWDFFLRAAERFRVKRVPFASVIYAFSDQGDNQSGDLGGMRQYYLDVLSEKHQLGKLPTKNFFVLLEEPAMKKREAESEIVWDGKPVASRLTAARQLN

SEQ ID NO: 8040 - protein, 270 aa, Bacillus licheniformis
MTMHKALTIAGSDSSGGAGIQADLKTFQEKNVYGMTALTVVVAMDPENNWNHQVFPVDTEVIRAQLSTIVDGIGVDAMKTGMLPTVDIIELAADTIKKHSMKNVVIDPVMVCKGANEVLYPEHAKALRELLAPLATVITPNLFEAGQLSRLGEIKTVEQMKEAAKAIHGLGAQHVLITGGGKLNHEKAVDVLFDGRDAEVIEGERIDTPYTHGAGCTYSAAITAELAKGSNVKEAIYSAKAFITEAIRESFRLNQYVGPTKHSALRLSGK

SEQ ID NO: 8041 - protein, 112 aa, Bacillus licheniformis
MLFSVQSLYDMLFLERVQYKGVVFVDQNQQKLTAMRLKKIADHIEDTREEYNGLLLQMKKLIGGIEDKPIPNDEEVQKKLQDTYEQMKEYALFVESIESFLRSSARTIKRES

SEQ ID NO: 8042 - protein, 478 aa, Bacillus licheniformis
MNQDQELRQKAMNRVEEYRDIVNLDPYRLHYHIMPPVGLLNDPNGFIQWKGVYHLFYQWMPFKTGHGAKLWGHYSSADLVNWRHEEIALTPSDWFDKNGCYSGSAIAENDVLHLFYTGNVRDGEGNRETYQCLAVSKDGISFEKQGVVARLPKGYTAHFRDPKVWKKNGSWYMVLGAQTENLEGRAVLFQSDNLKDWQFLGDITGSNTDQLGEFGYMWECPDMFELDGKDVLIVCPQGLEAEEMLYQNVYQSGYFVGELNELKPWFTHGDFEELDRGFDFYAPQTTKDESGRRILVAWMGVPDQDEQSQPTIPHQWVHCMTLPRELHLQNDKIVQKPVEELRTLRQNEKNAAISLNQGTEKLDIVQPDKAELFISPKVIEEGFEISFRGAARLIYNKAEGIITLERNSYVDEKTEARQCRLQELRNLNIFLDASSIEIFVNEGEEVFTARYFPYPGNNDVWISARKEIIMNVTSWTMA

SEQ ID NO: 8043 - protein, 459 aa, Bacillus licheniformis
MIHKEIAVRLIQLLGGEDNVISAAHCATRLRLVIKDEAKIDQEKVEELEGVKGAFSSSGQYQIIFGTGLVNKVYEQFAKELNLDQKETVQHSDAAKGKMNPLARFAKTLSNIFVPIIPAIVASGLLMGLLGMMKAFQWVDPDAALYKMLDMFSSAAFIILPILIGVSAAKEFGSNPYLGAVLGGILIHPSLFNPWGLATASPDVMDFYGLKIEMLGYQGTVVPILLAVYVMSKIEKGVRRIVPNAIDLLVTPFVTIISTGFIAFIAIGPLGRMLGTGITNILTYVYDVAGPVAGLIFGGTYSLIVLTGVHHSFHAIEAGLIADIGRNYLLPIWSMSNVAQGGAGLAVFFLAKRAKTKEIALPAAFSSFLGITEPVIFGVNLRYRRPFIAAMAGGALGAAYVVFMNVAANAYGLTGIPMIAIVAPLGMGNLIHYLIGMAISVTVAFITAFILGINEDEKK

SEQ ID NO: 8044 - protein, 276 aa, Bacillus licheniformis
MKIYKVLNNNAAIIKEDGQEKIVMGPGIAFQKGKNDTIPRNKVEKIFTIHEENEKFKQILETLPEEHIEAAEEIISYAEGQLSAPLSDHIHIALVDHLSFAIERVRKGFVIQNKLLNEIKALYKKEYEIGLWAIDLVKEKLKVELPDDEAGYIALHIHTAKMDAENMQKTLKYTNIIKELIEKIECCFNQKIDENSISYQRLVTHLRYAINRLESNEAFHVMDDDMLYFIRQKYPESYRCAAGLADYVKTEYDLHLPESEVGYITLHVQRLNDSYR

SEQ ID NO: 8045 - protein, 96 aa, Bacillus licheniformis
MKGLISFLKLWTAVLLNAVMPVRENQMKVTAFAGGTYQAADAYQAGGFSEKREEKTERMSGCKRMKPGSYTTEPSRAVCKKAVKRVRAGPTLYTGT

SEQ ID NO: 8046 - protein, 802 aa, Bacillus licheniformis
MRKSIVRYFVMAFILLFALSTFLTGVQATSVPDKKSPELEKAEIYGDIDVTSDKQTTVIVELKEKSLAEAKADGEKQTKASLKTARSKALKTLKKAKVNREYDRVFSGFSMKLPASEIPKLLAVKEVKAVYPNATYKPDSVKGKDVTLAADAIYPQMDKSAPFIGADQAWKSGYTGKGIKVAVIDTGVDYTHPDLKNNFGPYKGYDFVDNDYDPQETPTGDPRGGATDHGTHVAGTIAANGQIKGVAPEATLLAYRVLGPGGSGTTENVIAGIEKAVADGAKVMNLSLGNSLNSPDYATSIALDWAMAEGVVAVTSNGNSGPENWTVGSPGTSRVAISVGASQLPYNEYSVTLPSYSSAKVMGYQEEKDLEALNGQEVELVEAGLGQADDFSGKDVKGKVAVIQRGVIPFVDKAENAKNAGAIGAVIYNNATGEIEANVMGMAVPTVKLSKEEGEKLVQQIKEGKHSVVFSFKLDKKLGETIASFSSRGPVMDTWMIKPDVSAPGVNIVSTIPTHDPKNPYGYGSKQGTSMASPHVAGTAAILKQAKPDWTPEQIKGVLMNTAEKLTDENGKPLPHNTQGAGSIRIMEALKASSIVTPGSHSYGTFLKDKGKQTKKQAFTIENLSSHRKAYQLEYSFKGTGITVSGTERVVVPANQTGKAAAKVTVNSAKTKAGTYEGTVYIREDGRKVAEIPLLLIVKEPDYPRVTSVTVEPGAKQGAYTIEAYLPGGAEELAFLVYDENLNLLGQAGVYKNQGKGYQSYQWNGKINDAASLKSGKYYMLAYASAKGKSSYVLTEDPFIVE

SEQ ID NO: 8047 - protein, 84 aa, Bacillus licheniformis
MYMLSFIVLFGLSFIIVCFIFFTILYFAVNLQKREPKPFQKAAEQTVDTIILIPISWLFTALYICILFILFPIRHFLDFFQQKR

SEQ ID NO: 8048 - protein, 334 aa, Bacillus licheniformis
MSLSILDQTPVSEGSKPELALQHTVELAQAAERLGYKRFWVSEHHFSRNLAGSSPEVLIGYLAAKTEKIRIGSGGVMLPHYSAYKVAENFRVLEGLAPGRIDLGVGRAPGGMPIASMALQNGGRRMADQYPEQIQDLVTYLYDQADEHHRFPNLTATPNIATAPAVWLLGSSGESARLAAQTGASYTFAQFINGEGGEEAARLYKERFEPSVLGEQPNVIVAVFVICAETEEKAENLAKSLDFSLLANEQGMVTEGFPSLETALSYQYSPYERKRVEDNRKRMVIGTPQQVKEQLLELAGAYGTDEIMAVTITHDFQDRLDSYRLLAEAFHQSI

SEQ ID NO: 8049 - protein, 249 aa, Bacillus licheniformis
MNKTIETILNHRSIRSFTDRLLTEEEVRLLVESAQSASTSSYIQAYSIIGVTDPDKKRKLAELAGNQPYVEKNGHLFVFCADLYRHDKIARKKGVDITASLEGTETFMVSVIDAALAAQNMSIAAESMGLGICYIGGIRNNLNEVSELLETPEYVLPLFGLVVGQPANPSAKKPRLPLDHIYHENVYQADDAEFEKHLSAYDETISNYYQKRTDGKRSDKWTDQITGSLKKPPRAYMNEFVKGKGLNKR

SEQ ID NO: 8050 - protein, 391 aa, Bacillus licheniformis
MKSVIEELDALFPEMIELRRHFHQYPELSHREVNTPLTIANYLESLGIGVRTNVGGQGVVGHIKGGRPGKTVALRADFDALPLQDQKNVPYRSTVPGVMHACGHDAHTSALLTAAKALAKHRKDLKGNVVLIHQFGEEVTPGGAKPMIEAGCLEGVDAIFGTHIWAPMPVGQVGVKSGPMMAAADKFKVTISGRGGHGGAPHLTTDALITGASVVNHLQQIVSRRIDPTEAAVLSIGTFHSGQAFNVIAEEAVIEGTVRTFSKHVQETIIAEIERVIKGVCDSNGASFSLDYEKGYPPVVNHENETDIVRQCAKHVVGPEAVIELEPNMIGEDFSYYLEHVPGSFFFTGAGNPQTGAVYPHHHPMFDIDEKGMLNAAKILVSAALAFLNQD

SEQ ID NO: 8051 - protein, 389 aa, Bacillus licheniformis
MGQKKNTTSPYYQGDLIFILAMFFLISVIAVYAAEPSFSPKGYPAKQLFFYLLGISVIVGFLYFDLEQLEKLSIYIYLFGILSLLVLKVSPESIAPIKNGAKSWFQFGTITLQPSEFMKIGLIMMLASVISKASPKGSRSMQEDVRLLLKIAGVSAVPVGLILMQDAGTAGICMFFVAVMVFLSGVNWKLIFIVAGSGITLVLLVLFLVINFPEFSKDTLHIQQYQINRVMTWVDSSQQDANDTYQTEKAVTAIGSGEIFGTGINNLKVYVPEGQTDFIYAVIGESFGFIGCTFVVIMFFLLIYRLVVLIDKIHPYNKFASFFCVGYTALIVIHTFQNIGMNVGLMPVTGVPLLFISYGGSSVLSALIGYAIVYNASCQLTKYKGYMFK

SEQ ID NO: 8052 - protein, 394 aa, Bacillus licheniformis
MSQKKNITNPFYQGDLIFVYIVFFIISVVAVYAAQQFNQYNEPFAMKQSLYYLLGAFIIIVFLYFDLEQLEKLSFYFYLLGILMLIVLKFSPAYIGSYRFAPVINGAKSWFMLPGFTLQPAEFMKIGLIMYLASFMSKNGPVGKRTLKEDWIFLLKIAGIIIVPFGLILEQDTGTAGIVAFVILVMVFLSGVNWKLISLIFGTGLAAVALILYVIIKFPRCCGALGVEQYQINRVMTWVNPSEQNADDKMQVERAQMAIGSGKVFGNGVSDLQVYVPEAQTDFIFAVIGESFGFVGCTFVVIMFFFLIYRLVVLIDRIHPFSRFASFFCAGFTALIVIHTFQNIGMNIGIMPVTGVPLLLVSYGGSSVVATLLGFAVVYNSSCQLTKYQSYMFK

SEQ ID NO: 8053 - protein, 451 aa, Bacillus licheniformis
MDKALQKRKRLDIIKFLVPSLIGIILFMIPVKIEGNLTIPIAVFSNALQELLQQQLPLIMTVIVTATFILTFITKTFHPAFIKKSEFFYNLLNVSLFWYIVRLVGMIFAVMAYFKIGPEAVYAKSTGGTLLFSLLPVLFSVFLFAGLFLPFLLNFGLLELCGALMKNLMRPVFKLPGRSSIDCMASWLGDGTIGVLLTSKQYEEGFYTKREAAVIGTTFSVVSITFCLVIISQVGLPHMFVPFYLTILLAGAAAAVISPRIPPLSRKADTYITDQADQDQEKIPEGYTPFQWGLSQAVAKAKQNTSVKDFLQDGAKNVLDMWMGVAPVVMALGTAALIVAEYTPVFKWLGLPFIPLLELLQVPEAAEASQTLVVGFADMFLPSVLGSGIESEMTRFIIACVSVTQLIYMSEVGGLLLGSKIPVTFLDLVLIFLVRTLITLPVIVLCANFIF

SEQ ID NO: 8054 - protein, 86 aa, Bacillus licheniformis
MDMFFAYLLIASATPLFLWLDNKKVAISSIPPIILMWVFFFFYMTSSLSPTGHSLMIALFILNVVIAHVAAFIIYGLPLIRKHMSR

SEQ ID NO: 8055 - protein, 399 aa, Bacillus licheniformis
MNLIKWILFSVISFAFFQPAPAALLKEKDDYTILVYMIGSDMESDFHMASDDIQEMMDAGSSSNVNVVLQTGGAKKWANPSISHKVNQRWKVEHQKLVPLENVGKKNMDSPGSVTDFITWGVKTYPAKKYVLIFWGHGLGSVDGYGGDENFGNKKMKISELQSGIKTAYEHTKQKFDLIGFDNCKMAGIETAYALRDYGKYMLASVDYTNQNGWDYKRALQSVQDDPSIDPKELGREIAAGYVQQSKENGETEDLQQSLIQLNRVKDAVDALDRLSVNMNLALKEPDGKRLLHYARLAAEDYADESDMVDLADLSSLIGQQIGAEKEAKEVVKSVKKAVIMNIKSPEHPRGSGMSVYYPARDNHKRFAEKSKIYRLLDFSSRYQTFIKDYSHSTFNFDL

SEQ ID NO: 8056 - protein, 151 aa, Bacillus licheniformis
MSNIEELRLFRKEDIEWLQTWFEDAEVKRRLEGMLPLDEWFNFAGGNENYRVWAALEDGKPVGVVMVEVEEDLTGNIALLVDPFLRGGGYGKALIKRTMALPEMSRINKWFAGIEEDNKRCLACFRSVGYSLEHEQPDEDCYYSLIYFPES

SEQ ID NO: 8057 - protein, 602 aa, Bacillus licheniformis
MLKFYSFFKKLPQTASIIFYGLTLFWRCDPFKSAVLFLITLLNAMLGPLLVWLSAEVIDEIARAPFELSSWNALVWAAFAYIAFTLIVDALQPVAEMQKRLLTAKLEAYLDEMLMKKAISIPDIAAFEDASFHTNTQIIRYNEYFVTMWVSIVSQTFGGMVMIAASSLLIGMAAPWVPLLFLILAVPKLYWEAKLNNATFEGRKEVQELRRRAEYYAGVPLMSETAGEVKIYNLVPFFKSFYKNTSMELLHTLSNDQKKLALYQLFWSVLQSLAAGAVLIYIVHQAFHGGLSIGDVMLFIGAAVQFNEGINEMFAAFAIGARETRHLGNVHSFLNSKNSMENGETAPAVQKQKGFTCDQVEFSYDGTKTVLDIQQLDIPLNKTTVLVGENGSGKSTLVKLLLRYFDPNQGTISYNGLPLYKYDIEHYRSNAAAVFQDFLRYEMTLKYNIGLGDISSCTDLAKIKSASAFGGVDQFLHKLEDGYETELGRLFGGRNLSGGEWQRIAISRAFMRDESADILIFDEPSSALDVFIEEEIFDKLQKLTQGKTVIIVSHRLSTARFADHIIFLEKGRVAEAGTHQELMKNQAQYAELYRLQAEKYAQ

SEQ ID NO: 8058 - protein, 649 aa, Bacillus licheniformis
MKVKHVWKMKHIQEPLQTAGLLGKMVWKSGPRLMICMVIFMLIEAGAPLIQLYASKQMIDGIVDQEAVIYAEIWAVIYAGSLVMVSVVKSLEKWVKAMLSERSMITVNSLLIDAFDRIPGMRFFEDPKYRDRLETLRDRSTWLPSQFINISSNLVTAVMSLAGVVLIIAYLSPVLAFILILSTAPFAFVHNHYNEMEWEYHKDYAPVRRRAAYARHILLGRRSAKEVRLFGLGSFFLDLYQSAFKGLYSVLRNIQVRSARWSVLTGFLSGAGTGLGYFWILSQSHSSSFSVGDISLYLGAVFQLSTALRDIAKEGADTLDIWRMGRDFFLFMNAEKDIRLPSNGESLEGEGPLAVEFKNVTFRYPFREAAAGSRVNEADVDEEDLDMLDELEDEEMRGQDEQPESYDMHTGYVLNRISFSVSPGERIAIVGANGSGKTTLIKLLCRFYEYDEGEIKVNGKDIRKVDLQQLRNKMAVVFQEFGRYELSLRHNIAIGRTEALGDEEKLRAAARAAKLEPIVEELPEGLETMIGPEWGGTDFSGGQWQRIALARSFMKDAGLVILDEPAASLDIRAEYDIFRQFQSFTEGKTVIMISHRFSTVKMADRILVLKNGRIAEEGSHQELMDKNGEYSRMFRMQAKSFQGKDEVYC

SEQ ID NO: 8059 - protein, 473 aa, Bacillus licheniformis
MPAASYAFLGRDQAVHVHSYWGLPQLLNEKDLAGDAVPRFRELFQEVTADRLKDERHIVELSGGLDSAAVTAAAVAGGRKEQLLAVNISFAEPDMILSHDRDLVKNMMRDMDIPGLIILGDATAKIPNAEIGRDPLWFVDGPDPRANSLVNETFTVIAEEYGASSVLTGEGGDFIFSGEVSVIDSLLRQRRFSEIYKLLREWSGGSMKEMLKLGFQYGIAPFMPYIGEKLYYDLLWSDTEYELPEYFTEEHRKREWEINKEDHLRYRKSRELSVWGKRFHYDFLWPRARYMDAVGVTLHTYHPFLDRRLIEFSFSVPPEQHFDVLKGLEEHYAGSKMLLRKSFTDILPAYVYNRSTKTTYAHMARKSFMNDRRHVLQLFEPGERVFVEELGIIKRDIWWKHLLAMAIRSEDPNNDLGMGYQYMRSVIDLEIWLREASKGKEHLLDRSRPVKPRVMADIETVNTPEKAKIYSYQ

SEQ ID NO: 8060 - protein, 219 aa, Bacillus licheniformis
MKIWFGMQGNNTALWQEWVSAVKKWGRAERIHSYSCGIANMAEAHIRYDEAFRPSTQINLLHPVILDGWISGGLNAKSDGTRKIEQYDKLYASLKQDKAAMLSHSHGEYTMVWWDDSLHSLVLATDTYATRPVYYWVSPKGEWYAANDMRILLLVHDIPFAIDQDVCRMFPTSGFAVGENGFEIGRFLKEYAKCLRRPTLFSAGIKRFTCTAIGGFRSY

SEQ ID NO: 8061 - protein, 154 aa, Bacillus licheniformis
MKKRALVKNHEYFTTVHAFVRMMLLNYDFEEAYEKIAIHLFPLYASAKQRGAGLLDIDELHRNGEYLYSLDEDDHLVTSCVSIALTIQSILFSNGSDADLMIGVKKIDDKLFSHAWVQMENGKSIDPNHKNKNLKVLQTYKMSAYAERWVLSLV

SEQ ID NO: 8062 - protein, 90 aa, Bacillus licheniformis
MKIIRNQETATTVLENECIVLNLDNGQYFGLEGALKELWIEIENERKDKKDILIKWQSAFDQTEEELSAILNEAIQELTHHKLIKIEDKS

SEQ ID NO: 8063 - protein, 210 aa, Bacillus licheniformis
MIRVLLVDDYRVLTSGMKEILKKYNMDVIVCHEGNEALDLLKNQEVHIDVFLYDLKMPGMNGLELSLKTLEIEPQSKIIIMFSGDEIHSYFNKLIEAGVKGFIDKSYTDSMIASSILLCLKGAVLFPDGLLQKLRLDSDLSVDEHLTDTELDILQKVASGKTNKEIAADLQMSTRNVEYHLSKIYKKLKVTSRYCAVKKGTMLNLIKQKV

SEQ ID NO: 8064 - protein, 38 aa, Bacillus licheniformis
MRKLESAQVKSYGSFLTVTLSKKSKPGDGKFGRGVKRG

SEQ ID NO: 8065 - protein, 121 aa, Bacillus licheniformis
MAAKQSAEHSHFPWKHIVGFVLSIVLTLLALWVIYTDLSMAAKLWIIFGFAIIQAGLQLLMFMHMTESDSGKIQVGNTLFAAFIAVAIIAGSVWIFAAHNYHGDNPEGGSPGAKHSEHSGH

SEQ ID NO: 8066 - protein, 204 aa, Bacillus licheniformis
MEHAEHSNSNAPMEYRSEIGRLNILGFWIFLGAEIALFSTLFATYAVLHNRTAGGVLPAELFDAKLVLIMTFLLLTSSFTCGIAVHEMRRGSLKGVMIWMIITLLLGAGFVSYELYEFNHYVHEGATLSTSAYWSAFFVLLGTHGLHVSIGIFWIIGILLQTKKRGLTPQTSAKLFISSLYWHFLDVVWIFIFTGVYLIGLVNV

SEQ ID NO: 8067 - protein, 649 aa, Bacillus licheniformis
MNLKWDEFIITGDPLILGAQISILLTSIAIVFVLTYFKKWKWLWREWITTVDHKRLGIMYIIAAVIMFFRGGVDGLMMRAQLTLPNNGFLDSNHYNEVFTTHGTIMIIFMAMPFLIGLMNVVVPLQIGARDVAYPYLNNLSFWTFMVGAMLFNISFVIGGSPNAGWTAYMPLAGNELSPGPGQNYYLLGLQIAGIGTLLTGINFMVTILKMRTKGMTLWRMPMFTWTTLITCVIIIFAFPVLTVALALMTFDRLFGTAFFTLANGGMPMLWANLFWIWGHPEVYIVILPAFGIFSEIIATFARKQLFGYKAMVYSIVAISVLSFIVWLHHFFTMGNSAAVNSFFSITTMAISVPTGVKIFNWLLTLHRGRIKITTPMLWSLAFIPNFVIGGVTGVMLAMAAADYQYHNTYFLVSHFHYVLIAGTVFACFAGLIFWYPKMFGHKLNERIGKWFFWLFMTGFNICFFPMYFLGLQGMPRRIYTYGAEDGWTALNMIATFGALLMAAGFIVLCYNIFYSFRHSKREESGDAWGMGRTLEWATSSAIPPHYNFAVLPEVTSPDAFAQMKEDNVEIHPESKFKKIHMPSNSGRPFIMSLCFGFAGFGLVFEWFWMGIVGLIGVFLCMILRSFEYDDGYYVSVEEIKETERKNAK

SEQ ID NO: 8068 - protein, 319 aa, Bacillus licheniformis
MFRAFKPLIMLTLLSSVFLLGGCSQIAVLDPKGPVASQQRDLILLSIGFMLFIVAVVFVLFTVMIVKYRERKDRKSPYSPEVEGNTFLEIVWTVVPILIVIALSVPTVQTIYSLEEAPKASKDKEPLVVYATSVDWKWVFSYPEQDIETVNYLNIPTDRPILFKISSADSMASLWIPQLGGQKYAMSGMEMEQYLQADHEGTYKGRNANFTGEGFAEQKFNVNAVSESKFNDWVKKTQKEAPKLTKTQYDELMLPQHADEMTFSSTHLKYVNHGNDAEYAIKARERLGYKPLSPHSKSDPFENVKTNKDQKQSEDQDSH

SEQ ID NO: 8069 - protein, 329 aa, Bacillus licheniformis
MAILVCGGAGYIGSHAVAELLSRNEDVVIIDNLQTGHEEAALKGASFYNGDLRDEAFLRKVFQENDIEAVMHFAADSLVGESVTDPLKYYDNNVYGAVCLLKVMKEFDVKQIVFSSTAATYGEPDRVPIMETDPTDPTNPYGETKLAIEKMLKWSEKAYGIRHVVLRYFNVAGAHVDGLIGEDHQPETHLIPIILQVALGKRDKIMIFGDDYPTPDGTCIRDYIHVMDLVDAHILAVERLRNGGESAVYNLGNGTGFSVKEVVETARKVTGCPIPAEVAERRAGDPAQLIASSEKAVKELGWQPKYAELETIIDSAWKWFKAHPNGYQS

SEQ ID NO: 8070 - protein, 35 aa, Bacillus licheniformis
MLFSFYHLQHFPACIFIISSNKKLGEKRIERPSFH

SEQ ID NO: 8071 - protein, 41 aa, Bacillus licheniformis
MDKDWVILMKEAKKLGLQIEDVKEFLRSQPIQSDAEKQIKQ

SEQ ID NO: 8072 - protein, 72 aa, Bacillus licheniformis
MVSKGLRPKAPPPFRRKAIETDTEESVWGCWHQRWSAMPLKRLNQSGLVPLKRVKLEKVKQPMYRAKGKAAP

SEQ ID NO: 8073 - protein, 82 aa, Bacillus licheniformis
MMNMGIAAICGSSRENGNTEELVNRLVDGLDADKIYLRNYHIEPVSDYRHGNTAPLYPDDDYRDLISRVLEKDILIFATPIY

SEQ ID NO: 8074 - protein, 104 aa, Bacillus licheniformis
MGEGKIDYSKAAASPEFQRLLKRKRAFIVPMTIFFLLFYFLLPVMTSYFTFLNQPAVGAITWAWVFAIAQFVMTWTLCIVYTKKAGQFDQIASDFKKKIGGVDS

SEQ ID NO: 8075 - protein, 512 aa, Bacillus licheniformis
MSATAFILFLAIVALTLVITYFAAKQTKTANEFYTAGGGLTGIQNGLAIAGDYMSAASFLGIAGMIALNGFDGFFYSIGFLVAYLVVLYIVAEPLRNLGKFTMADMIASRFKQKKIRGVAALNTITISTFYMIAQLVGAGALIKLLLGIDYTLAVCIVGVLMTIYVVFGGMIATSWVQIIKAVLLMAGTLIISVIVFSKFGFSLTNMFEQMKTATPLGADFLNPGNKYKVPLETLSLNLALVLGTAGLPHILIRFYTVKDAKTARKSVVSATWIIGIFYIMTVFLGFGAAAFVGFENILAADKAGNMAAPLLAQALGGDFLFAFVSAIAFATILAVVTGLVLSAASAFAHDIYSQIIRKGAATEKEQMIAARWASIGVSVLSILLAVFAQSLNVAFLVSLAFAVAASANLPLIIFTVFWKRFNAAGALAGSLTGLLSALILVSISPSVWDPAGNAIFVGDPLIPLSNPGIISIPLGFLGAYLGTILSSKTPGQDAFAEIQVKAHTGIHMDQS

SEQ ID NO: 8076 - protein, 499 aa, Bacillus licheniformis
MEYVIGVDLGTSTVKIILVNQRGELCGEVSKPFSIIEPHSGYSEQDPAEWADKTKEAIKELVGHFPGKASQIKGVSFSGQMHGLVLLNGKGEVLRNAILWNDTRTTEQCRLINDKIGKERLLEIAKNPALEGFTLPKLLWVKEYEKELFEKAAVFLLPKDYVRYTMTGRLHSEYSDAAGTLLLDVRHQTWSGEICRKLGIPESLCPDLIEPGACVGGLRPEFAAETGLSPEVKVFAGGADNACGAVGAGILKEGTALCSIGTSGVVLTYESNRDQEFNGNIHFLNHAAPDAFYSMGVTLSAGRSFSWFKDVFAGQASFDELISDIGHSRPGAGGLLFTPYLSGERTPHADADIRASFIGMDSAHTRADFVRAVIEGITFSLHESIEQFRAGGKDISRVISIGGGAKSNQWLQIQADIFNADIIRLTSEQGPAYGAAMIAAVGCGWFPSLEACADRFVLIKETFSPRREYSRQYEALFQIYRDVYRHTKTLNERLASFRE

SEQ ID NO: 8077 - protein, 448 aa, Bacillus licheniformis
MFFRNIGMIEYEGADSENPYAFKYYNPDEFVGGKTMKEHLRFAVAYWHTFDADGKDPFGDGTMFRAWNRLTHPLDKAKARAEAAFEFFEKLGVPYFCFHDVDIVDEGATLRETFTYLDQMSSFLKEMMETSHVQLLWNTANMFTHPRYVHGAATSCNADVYAYAAAKVKKGLDIAKELGAENYVFWGGREGYETLLNTDMKLELENLSSFYRMAVEYAREIGFDGQFLIEPKPKEPTKHQYDFDAATTIAFLETYGLKDHFKLNLEANHATLAGHTFEHELRVAALHDMLGSIDANQGDLLLGWDTDEFPTDLYSAVLAMYEILKAGGFKTGGINFDAKVRRPSFADEDLFHAHIAGMDTYAVGLKVASRLLEDKALDQVIEERYESYTKGIGLEIKEGRTDLKKLAAYALENDHIENQSGRQERLKATVNRYLLNALREAPAGKETH

SEQ ID NO: 8078 - protein, 387 aa, Bacillus licheniformis
MNTADQALVKKMNKALIFEQIIENGPVSRAKLSEITGLNKATVSSQVSSLLQKDIIYETGPGESSGGRRPVMLKFNRKAGYAVGVDVGTNYIIVALTDLEGHLIEQFERTLDEEDIQATEEALIELTGLAVDKIPPSPFGLTGIGVCVPGLVDNERHVVFTPNKPIHLIPIKEKLEERFGVPILIENEANAGAVGEKEYGEGGQLEHAVFVSINTGIGLGILMNGKLFRGVQGFSGEAGHMSIHFDGPLCRCGNRGCWELYASEKAVFSHYAANSGAQLYETVKELADRGDPGTMETFERFGFHIGIGLLNILKTLNPDTIILRNTIVESYPSIVDAIKKTIASRSAAEALSNYHLKISTLGRTASALGMSSLVTERFLERFMNERF

SEQ ID NO: 8079 - protein, 224 aa, Bacillus licheniformis
MTRVSEEAMKDLLSVYFIMGSNNTAGDPLTVIEKALKGGATLFQFREKGEGALKAGDQTAFARQVQALCKQFNVPFIINDDVELALELDADGVHIGQDDDKAADVRARIGDKILGVSAHTLEEVLKAEKDGADYIGAGPVYPTETKRDTKAVQGVSLIQEIRRQGIGIPVVGIGGITVENCVPVIEAGADGISVISAISKAADPKQAAEAFSEKVQATKQSAHS

SEQ ID NO: 8080 - protein, 269 aa, Bacillus licheniformis
MNMEDAARGIELVRKQKPLVHNMTNNVVTNFTANGLLALGASPVMAYAREEAADMAKIAGALVLNIGTLSRESVEAMIIAGKSANEHGVPVIFDPVGAGATPFRTESAQAIMRKVKVSAVRGNAAEIANTLGEDWLIKGVDAGEESGDRTELAKKAAKLWDTAVIITGAEDVITDGTKTYTVGNGHQLLTKVTGTGCLFTSVIGAFCAVEKDVCRAAVSAAAFYGTAAELAAAKTESRGPGSFQIEFLNQLAAVEAMDIKERGRIREVE

SEQ ID NO: 8081 - protein, 197 aa, Bacillus licheniformis
MIGDFRDKYPNVTFQLVEHGSVKVQEGVEDGSLDIGVVVLPAKEEIFHSFTIVKEDLMLIVHLSHRFADAEEIELRQLSEEPFIFFREDFVLHERIITACLKAGFQPNVIYETSQWDFISEMVSANLGIGLLPERICRDLDPERVRIIPLVRPAIPWHVAVIWRKDRYLSFAARAWIDHTKSYIWSENSKTERNAGE

SEQ ID NO: 8082 - protein, 108 aa, Bacillus licheniformis
MDIRHLTYFLEVARLKSFTKAAQSLYISQPTISKMIKNLEEELGIELFYRRGRQIELTDAGQSMYVQAQEITKSFQNLTSELNDLMDVKKGHVRIGLPPMIGSGFFRK

SEQ ID NO: 8083 - protein, 89 aa, Bacillus licheniformis
MSKTIKLNHAAVMKKLEQVSSTLQAVSLKSPPAGALGRNNLDFTKKWLEREAEICNMVKQYKEAVRKNIEDTRSNVDTLKEQDEAIARR

SEQ ID NO: 8084 - protein, 145 aa, Bacillus licheniformis
MTIMDYSDTLQKIHGVLSHKAAELEEQIARLERAKRDVEREQNLGIEEIRQILRPNLNESWTGSRAADFDEARDEAHTAMYRIFTDEYDRYIHKIDLKIFALDAEKGAVQAASWSADRADFLMEKGEEAVDALHSTINGLKGWLK

SEQ ID NO: 8085 - protein, 128 aa, Bacillus licheniformis
MKTFIKGLGQVALLFLFARFMNLIVEVLHINIPGSILGIIVIFALLHFKIIKLEWIEIGALWLLAELLLFFVPSAVGIMNYGDILAEFGTSIILVVLISTFVVMVSTGMLTQLIAKRKERKKTCSSDA

SEQ ID NO: 8086 - protein, 227 aa, Bacillus licheniformis
MLIGCLSLIATVLIYLGAKAVYSRHPKVYASPLLVTPVILVGLLLFINVPFEAYNAGGRLLTDMLQPATVAFAIPLYKYFPVLKKYAVEIIINVAVGCCIAILSTAFIAKLFKLNEDLIESLVPRSVTTPIAMNVSEMIGGMPAVTAVFVILTALFGSVIGPMVIRYFRIDNEIARGVLLGTSAHGAGTSKAFELSSVSGTISSVSMILAAIITLCAAPFLISLIAV

SEQ ID NO: 8087 - protein, 95 aa, Bacillus licheniformis
MMAFVKVLLTTAFLTGAFAGFLWAFSKEKGDGFFSEMAADGSGVFTLFGLIGLLNVKLLKAISPKLLHDRSFRCISFILAVVLLMMSIFIWLIDF

SEQ ID NO: 8088 - protein, 488 aa, Bacillus licheniformis
MNYGILISIGIYMAGMLFIGYFAYRRTSNLTDYMLGGRNLGPAVTALSAGASDMSGWLLMGLPGAMFLNGLSSGWIVVGLTIGAYLNWVYVAPRLRTYTETAGNSITIPDYFENRFKDGSRLLRMTSAFVILVFFTFYTSSGMVAGGELFRTAFHLDYRIGIWLTAGVVILYTLFGGFLAVSWTDFVQGTIMFIALILMPVVVFVQLGGIAPAFSEVNAVNPDLLRPFQGTTVIGIISLLAWGLGYFGQPHIIVRFMAISSVKELKSARRIGMGWMIFSICGAMLTGLVGIAYFSANHLTLKNAETIFIKLADLLFPSMITGFLLAAILAAVMSTISSQLLVTSSALTEDFYKAFIRKGASDKELVLVGRLSVLAISLIALLMALHPNETILNLVGYAWAGFGAAFGPVVLLSLYWKRMTKWGALAGMLSGALTVIVWEQVKAFDPVYEIIPGFIVCTVVIIAVSLMTKKPRAEIEKEFETAVEQLKG

SEQ ID NO: 8089 - protein, 396 aa, Bacillus licheniformis
MHTLKIKHPFAAKMKKGYPLIEKEAVSSQENGIKEGSLIRITDENGRFLGKGYYGEQNKGIGWILTRNEGESIDQSFFLSRLAKAFQARKSLFQDPDTTAFRLFNGEGDGIGGFTIDYYDGYYLFQWYSKGIYTLKETIMEALDELTDYKAVYEKKRFNTAGQYVEDDDFVKGERGDFPIIVKENGIHFAVYLNDGAMTGVFLDQRHVRKAVRDRYAEGKTALNTFSYTGAFSVAAALGGAEKTTSVDVANRSLSRTIEQFSVNGLDYEAHEIKVMDVFKYFQYAAKKELAFDLVILDPPSFARTKKHTFSAAKDYKNLLKDAIRITKDQGVIVASTNSSAFGMKKFKGFIEEACKETGTRFTVLEEHSLPEDFKTVKSYPEGDYLKVVFLQVRHR

SEQ ID NO: 8090 - protein, 126 aa, Bacillus licheniformis
MARIDHVGLMVKDIDASIAFYQNVIGMTLKGRMTHTNGVMKLAFLGFENRDETELELIEGYNDNLPQEGKVHHFAVSTDDIEAEFDRVKGAGIKLMEDEITVLPNGFRYFFLFGPEGEMVEFFQRT

SEQ ID NO: 8091 - protein, 206 aa, Bacillus licheniformis
MAFGLLLSGARSIPQSNAAVKAGLWQAAMGYELDGKTLGLIGFGEIGKKVARRAAGFNMNVLAYGTYKDYNAAKRLNVRFAELDDLLEKSDFVCISTSLRPATYHLINQEKLAKMKKTAYLINIARGEVVDESALIQALEQKQIRGAALDVFETEPPAARIAGLSNVICTAHIGGATYESIRRIEEMTYQNIKRFIEKQQPAFRVQ

SEQ ID NO: 8092 - protein, 101 aa, Bacillus licheniformis
MVKVLLTLNGLFYRAAPRLRERVERLGAEFAFLDSNRLTRQDLLTHIKDVHIYIAGVEKADRELIDAAPGLRYIMKFGAGIDNIDVEYANEKGILVTNAPG

SEQ ID NO: 8093 - protein, 287 aa, Bacillus licheniformis
MKSDRTMHIISCTDNNYAQHLSVMFSSLLTNMDQTREVKLYVIDGGIEPENKKRLEETTLQFGAPITFLNVEKSQYDKAVESSHITKAAYYRISIPDLIDDESVKRMIYVDCDALVLEDISKLWDMDISPYFAAAVEDAGQHERLKKMNISDEAKYFNSGLMIIDMEAWRKNDISKKVIDFINNNDEDMFVFHDQDALNAILYDQWLELHPRWNAQTHIILKEKTPASLIDQKRYMETRANPAIVHFCGGNKPWNSNTSHPYARQYFKYLQSTAFNQPAKLSKNHVS

SEQ ID NO: 8094 - protein, 407 aa, Bacillus licheniformis
MLIRNPFKEKYYSHDRRALNMLALRVPGLAFILMIYVASIVLQFLNGSWSILLLNVFTVLTAIFALLHWHSYRWVKKRVILYFVLQGLITFTLANVMSGFLVLIIIGLYAFLIGQIIGMADRRKTFLILYLLLLLSITVLYHIHKGEYLHFLVIAVPIMIVIITYAATFFAQVDEKTKAQLTLERLELAHQQVEQLTLQNERQRMARDLHDTLAQGLVSLNMQLDAIHVHLAKDNTERAKEIVQQSMNRVKSTLADARSAIDDLRSKSEEIGFLKERITSLMDHFQESTGMACFLDYRLDQVPDVRTAENCYYIIGECIANAVKHAEAETISVSIWDDDKRRLHLTVKDNGKGFDVEKGKKKRGHYGLLGIEERVRAMKGQFNIKSTTSKGTQIDITVPIQGEMPDE

SEQ ID NO: 8095 - protein, 212 aa, Bacillus licheniformis
MNKVLIVDDHLVVREGLKLLIETNDHYIIIGEAENGKAAVRLADELKPDIILMDLYMPEMSGLEAIKLIKEKHDIPIIILTTYNEDHLMIEGIELGAKGYLLKDTSSETLFHTMDAAIRGNVLLQPDILKRLQEIQLERMKKQSSDTQLTEKEVIVLKAIAKGLKSKAIAFDLGVSERTVKSRLTSIYNKLGANSRTEAVTIAMQRGVLTLD

SEQ ID NO: 8096 - protein, 724 aa, Bacillus licheniformis
MSKMLYKLGGWVARNRIKVICAWIVVLVASIGLAITLKPSFSEDMSIPDTPSEKAMDVIQKEFPHGPDKGSIRVIFGAEDGEKLTSKSAEKAIENTLKEIDKDGSVDSIASPFVTGTIAKDGTVAYADIKYKSSADDIKDYSIKHLKDSLKMADYEGLQTELSGDVPGAEMEIGGISEIVGIILAFIVLAITFGSLLIAGLPILTALIGLGVSIGLVLIGTQVFDIASVSLSLAGMIGLAVGIDYALFIFTKHRQFLGEGIQKNESIARATGTAGSAVVFAGLTVIVALCGLTVVNIPFMSAMGLTAGLSVLMAVLASITLVPAVLSIAGKRMVPKANKKKEKQSAETNVWGRFVTKNPIMLSVCSILILLVISIPSMHLELGLPDAGMKAKDNPDRRAYDLLADGFGEGFNGQLTIVADAASVTENKAEAFADAVKEIKELDHVASVTPAMPNKEGNFAIITVVPETGPNDAATKDLVKDVRSLSDKNGVDLLVTGSTAVNIDISDRLNDAIPVFAVLIVGFAFVLLTIVFRSLLVPLVAVAGFILTMTATLGICVFVLQDGNLIDFFKIPEKGPILAFLPILSIGILFGLAMDYQVFLVSRMREEYVKTKNPVQAIQAGLKHSGPVVTAAGLIMIFVFAGFIFAGEASIKANGLALSFGVLFDAFIVRMTLIPSLMKLMGNAAWYLPKWLDKIIPNVDIEGHQLTKEIQPETAHEQKKQISM

SEQ ID NO: 8097 - protein, 246 aa, Bacillus licheniformis
MKTYFQKDYQLGSFQLFSASHIVTLLVIAALGVCLFVFRKTLQKPEWNRLIRYVFVAVLIISEIGYHSWFVYVNSWTPRYCLPLHLSDLSVYLVIILLLTKNLNLFKFLYFAGLGSALQAILTPDLGRYGFPHFRFFEFFISHGIVVLACLLMIAAERYKPTVRSLWVTFLLVNVYGALIFLINRLLNSNYMYMMKKPGGGASLLDVLGPWPWYLLSAEAVTIVFFYLLYLPFWIAGKVREKKDHA

SEQ ID NO: 8098 - protein, 443 aa, Bacillus licheniformis
MKQTTLKEKPTKVRVRVLLFIFVCVVINYMDRSNISVAASAIGDDLNLSAVQLGLIFSAFGWAYCALQIPGGGLVDRFGPRLVYGFTLVTWSLATLLQGFVRGFGSLFGLRLATGAFEAPAFPTNNRVVTSWFPEQERASAIAFYTSGQFAGLAFLTPALSAIQHVVGWRGLFIVTGVIGIIWGLIWYIFYRDPDRHPKVNKAELDHIEKGGGIVRRGRTSEKEKLAFTWKHFKQVTAHRKLWGIYIGQFAVNSTLWFFLTWFPTYLVKYRGLDFLQSGFLASLPFLAAFTGVLLSGFLSDFLIKRGVSAGVARKTPIITGLFLSISIIGANYVDQTSLIILFMTLAFFGNGLASITWVLVSSLAPKHLIGLTGGVFNFVGSLASVIVPIVIGFLANGGSFAPALVFIGALALAGALSYIFLVGKVERIQVNDNAEENDSISM

SEQ ID NO: 8099 - protein, 382 aa, Bacillus licheniformis
MKITGFECFLIPPRWLFLKIETDEGITGWGEPVIEGKAATVKAAVGELMEYLIGKDPMNIEDHWNVMYRGGFYRGGPILMSAIAGIDQALWDIKGKFYNAPVHQLLGGKNRESIKVYSWIGGDRPQDVGLAAKQVVDKGFTAVKMNGTEELQYIDSHEKIDQVIERISAVREAVGPYIGIGIDFHGRVHKPMAKILAKELEPFRPMFIEEPVLPENNEALRDIASLVSIPIATGERMFSKWQFKNLLTDGYVDIIQPDLSHAGGITECKKILSMAEAFDVAAAPHCPLGPIALAACLQVDATCHNAFIQEQSLGIHYNKGTDLLDYIVDQKVFFYEDGYVRIPDGPGLGVDINEDHVRKMADIGHNWRNPVWRHKDGSIAEW

SEQ ID NO: 8100 - protein, 207 aa, Bacillus licheniformis
MVLSHIEEQKLIAIIRGYNPEEAVSIAGALKAGGIRLVEITLNSPQAIKAIEAVSEHFGDEMLVGAGTVLDPESARAALLAGARFILSPTVNEETIKLTKRYGAVSIPGAFTPTEILTAYESGGDIIKVFPGTMGPGYIKDIHGPLPHIPLLPTGGVGLENLHEFLQAGAVGAGIGGSLVRANKDVNDAFLEELSKKAKQFVEAAKQ

SEQ ID NO: 8101 - protein, 317 aa, Bacillus licheniformis
MDVISIGETMALFTPNEDGPLRYARNYQVRIAGAETNTLIGLSKLGKKAGWITRLGKDEFGAMILSSVRGEGVDVSQVKLDDAAPTGLFFKERKSAAKVNVFYYRTLSAASFLKKCDIDEQYIEKAGLLYITGITPALSESASDAVFYAVELAKKHNKCVVFDPNFRKKLWDGERARQTMFELIKRSDIVLPGLSEGRFLFGTADEKKIAEAIRGLGAETAIIKLGSKGAYYAGGNESGYAEGYQIQAAADPVGAGDGFAAGVLSGLIDQIPLSEAVKRGCAVGAMVAAVNGDIEGLPDRESLFAFMEQSDEEDVSR

SEQ ID NO: 8102 - protein, 252 aa, Bacillus licheniformis
MSVKSAVRVVRIFELLSNHPDGLTVKEISKELSLPQSSTFNLAATLLDEGYLQQDAVKRYRLGAKLIQVGTAAMESIDISSQGVPFLKQLMDGVQETVFMAVLSDDQLVYIAKIDNNRSIRTTAQPGSRKPLYCTGLGKAFLAFMPEDKREGLLDRMEFIRFTGHTITAREELEKQLQTFLEQGYAVDNEENEEGLFCLAAPVYGPDGVMKAAISTAGPKERMLARKAVIVEQLLHTAGKITESIGGYRKPL

SEQ ID NO: 8103 - protein, 449 aa, Bacillus licheniformis
MKRKMMMFGLALSIIAGGVVADGTGNAAQAAPQETAIAKDIEKFSKKFNENRAYQTIYHLSETIGPRVTGTAEEKKSAAFIASQMKKSNLKVSTQKFSIPDRLEGTLTVQGNNVPARPAAGSAPTAAEGLAAPLYDAGLGLPGDFTEEAKGKIAVILRGELTFYEKAKNAADAGASGVIIYNNVDSLVPLTPNLSGNKVDIPVVGVKKEDGEKLLSEQEAILKLKAHKNQTSQNVIGVRKAKGVKNPDIVYVTSHYDSVPYAPGANDNASGTSVVLELARILKTVPADKEIRFITFGAEEIGLLGSRHYVSTLSNQEVKRSVANFNLDMVATSWENASQLYINTPDGSANLVWQLSKAASLSLGKDVLFLHQGGSSDHVPFHEAGIDSANFIWREPGTGALEPWYHTPYDTIEHISKDRLKTAGQIAGTAVYNFTKKENRKPSYSSVAQ

SEQ ID NO: 8104 - protein, 453 aa, Bacillus licheniformis
MAGLKKKRALFLTAVASGTMLNPLNSSMISLALHSIQHEFHLSFATVSWLISSFYLASAVAQPVTGKIGDLIGRKKMFLSGLVLVAVSAIGAPLAPAFSVLLIMRLFQSIGSGAIYPSGVGLIRSHIHEKQASALSVLSIFSSAMTAFGPTVGGFLIVLGGWPAIFLVNFPFILFSFLLGMYMFPKDEKKAGLNVRAVIKRLDLTGILLFAGGIVLLLAFLLSLSTGEPRFAEGMFGLVLLLMFVWWELRVNSPFIDIRLLIARRTLTSVYAQFIMLNIFNYCLFFGLPSYFQDEMHLSVQTSGLLMLFMSGTSVLISPFVGKWIDRSGETQPVLIGSCLMAAGAILLTLFFVDAPMLWKGIILSLLGVSYGLGNVALQAAMFTASPPDIVGTTSGLFQTCRYLGSIFSSVILGLLFGEEITAGHFQDLGMVMIAVAIGSILMSFRFIKLMKD

SEQ ID NO: 8105 - protein, 70 aa, Bacillus licheniformis
MKSDIEKRAECGLQNGTEAMMNRESQRLDAALYGAVLNAFGCDDRSRLMSGEAGAGGKAGGAGERLLYPK

SEQ ID NO: 8106 - protein, 219 aa, Bacillus licheniformis
MDMAIDKMIGLPEAQIEDLRNLMEDWKNELLVYKFALDQMDTKFSIISQEYNLIHGHNPIEHTKSRVKSFESLINKLVRKGCDITTKAAKEHINDIAGLRIVCSFLSDIYNMVEVLKEHEDIKILKMKDYIKNPKPNGYRSLHLIVEVPVYLTNRVEHAKVEIQIRTIAMDFWASLEHKIYYKLNNEVPNQLTDELKEAADIANYLDEKMLHIRTKADQ

SEQ ID NO: 8107 - protein, 36 aa, Bacillus licheniformis
MKWLLNTSYYFLILVLLFLIYGFHTANTGSYIYNDF

SEQ ID NO: 8108 - protein, 502 aa, Bacillus licheniformis
MKLIETIKKYAQTQPDTLAFVNEEEKLTYGELWSQSERLAARIQSEALTDASPIIVYGHMKPVMAVSFLACVKAGHPYIPVDVSIPADRILKIINSSKAELLLNNSGTSVDTGDALISVVEPGVLEGDGVPETDPGRWVHGEDTFYIIYTSGSTGNPKGVQISADNLQSFTDWITNDFPVESGQVFLNQAPFSFDLSVMDLYPCLQSGGTLWTVTKDMINRPKLLFEALKQSNVNVWTSTPSFAQMCLMDPSYSEELLPELSLFMFCGETLPASVARQLKERFPKARVFNTYGPTEATVAVTSIEVTDDVLNKYSSLPVGSEKPETEIVIINEDGKAVQDGEKGEIIITGASVSKGYLGEKALTEKAFFSYNGSPAYRTGDAGYKENGQLFFLGRLDFQIKLHGYRIELEEIEYQINQSRYVQSAVVIPFYREEKIEYLIAMIVPAEHDFEKEYQLTSAIKKDLGSKLPAYMIPRKFMYQKEIPMTANGKIDRKRLKEEVTV

SEQ ID NO: 8109 - protein, 385 aa, Bacillus licheniformis
MTPYGSFLFFIILGILLAPTIILGLNGKSFRLYNMAVSVLVLALIFSNSLHGLIMLCLFTLWQTVLIKGYIAYRLKANSGIVFCLAAAASILPLALSKLLPFFAVDNWATFLGISYLTFKGVQLIIETRDGLIKKQLPISRLLYFILFFPTISSGPIDRYRRFEKDDQTVWTKEQYEELLYKGINKIFLGFLYKFIIGYCINTYVIMKLPFLTSGSFSHGLAYMYAYSLYLFFDFAGYTAFAVGVSYIMGIKSPENFNKPFISRNIKDFWNRWHMSLSFWFRDYVFMRFVLWMTKKKWITNRMAVSNIGYVLLFLLMGVWHGLAPQYIVYGLYHALLMVGFNFFEKWNKKHKWWPNNKWTTAVSIVVTFHFVCFGFLIFSGKLIH

SEQ ID NO: 8110 - protein, 78 aa, Bacillus licheniformis
MDFNQEVLSVLAEVCQDDIVKENPDIDIFEEGILDSFGTVELLLAFESHFNITVPITEFDRDAWNTPNQIIKQLNELR

SEQ ID NO: 8111 - protein, 389 aa, Bacillus licheniformis
MKKRFLFGPIILAFLLFFTAILIPNAWLTKLVPKDRVETSATELNPMMFQGMYLQGKALEDPKYLPIFGSSELSRLDAFHPSNYFKVNNQGFTPYLVGKGGSQSLIHAINFAAQSDQLKGKKIVFIISPQWFQKHGSDEAHFAPNFSALQAYDLVFNQNVDSGLKKKIIKRMLKFHAVKNDALLSALFKAELDQDKVALSLLTPPAKAYQSILEKKDIYYSMVEGDGPKRTISQDVKNKSWDELKQMAEKVGAKESRNNEFKISNGVYKKLKPKLKKLKGHNKKMNYAESVEFHDFHLMMDVLKESGAEPLFISVPVHGKFYDYTGFPKKGRTDFYKKIKKEIEQEGFQVADLTNHEYDPYFLKDTLHLGWKGWVYVDQEIEAFYKKSS

SEQ ID NO: 8112 - protein, 363 aa, Bacillus licheniformis
MTKQTISVQLSTAKKQKPEADKLEFGRTFTDHMFIMDYTAENGWHDPRIVPYQPIEMDPAAMVYHYGQSVFEGLKAYLSSEGRVLLFRPEKNFERLNKSNDRLCIPRVDPEIVLEGLKQLVQIDKEWIPQAEGTSLYIRPFIISTEPYLGVAPSNMYKMLIILSPVGSYYKEGIRPVKIAVESEFVRAVAGGTGNAKTAGNYAASLKAQEVAESKGFSQVLWLDGVEKKYIEEVGSMNIFFKISGEIVTPALNGSILEGITRNSVIHLLKQWGLSVTERKISVDELVQAHKDGLLEEAFGTGTAAVISPVGELIWKDESLVINNGQTGEIAKRLYQTITGIQKGALPDTFGWTVEVDKVSQSC

SEQ ID NO: 8113 - protein, 420 aa, Bacillus licheniformis
MDQTKLSVWEKNYTFLFISRLIKISADCFAFNSILWFLIFDGKGAIGTSLLLAVTFLPEAFLAPITGPLVKRSALKFWMYFSDLTRAAVVITIPICYLNGFSPMWFVLGLMIIHSATGATYNPASITLIPQIVNENLIQKANAILQSSSEIIRLGAVTLCGVLLTFIGPATTLVFSFIFYIISGLFMLCIKYSITRTHSQSKSLAQRGTYFARLKRGFTLVKNHKILYPLAIYCIFMNLAASPWEALSAVYVAEDLNGTPFIHSLLKATTAGGAFLLGFILAKVKINRYGLLFITAGILEGAAYFIAGLNTFLPLVFLAAFAFGAAISSINVPEFTIIQTSVEGDDQPQVFAVIHMITNLSLPLGAIACGYAAKMLGAGNVIAIGGFIEIIAGIGILIFTQLARARRSDLIKEKEASANM

SEQ ID NO: 8114 - protein, 442 aa, Bacillus licheniformis
MKKGLKIVTIGGGSSYTPELVEGLIKRHDELPVSELWLVDIPEGEEKLNIVGTLAKRMVEKAGVPIKVHLTLDRREALKDADFVTTQFRVGLLEARAKDERIPLKYGVIGQETNGPGGLFKGLRTIPVILEIAKDIEELCPDAWLVNFTNPAGMVTEALLRYSNLKKVVGLCNVPIGMKMGVAKALDVDESRIDIQFAGLNHMVFGLDVFLDGVSVKDKVIEAMADPENAMTMKNISGESWEPDFIRGLGLIPCGYHRYYYKTQEMLEHELEASKTEGTRAEVVQQVEKELFELYKDPELAIKPPQLEKRGGAYYSDAACNLISSIYNDKHDIQPVNTMNNGAIASIPDDSAVEVNCVMTKNGPKPIAVGDLPVTVRGLVQQIKSFERVAAEAAVTGDYNTALVAMTINPLVPSDKIAKQILDEMLEAHKEHLPQFFRSVEA

SEQ ID NO: 8115 - protein, 109 aa, Bacillus licheniformis
MSEELEQTIFQIILHGGNGRSFCMEAIAEAKKGDFAAAKEKIRAADEELIRAHHFQTALIQNEAKGAKTEPSLLMIHAQDHLMNAMTMKDLAAEIVELYEKMNIHGGVN

SEQ ID NO: 8116 - protein, 450 aa, Bacillus licheniformis
MNKFNAFLEEKIMPVAGRIAAQRHLQALRDGIILTMPLIIIGSLFLILANLPIPGYPEFMAGIFGDQWAEKLSYPVNVSFDIMALIATFGIAYRLAEKYDIDALSSGAIAVAAFLLATPYQIPFTPEGATEEILVSGGIPISLMGSKGLFVGMLIAMFSTEVYRWVVQKDIVVKMPDGVPPAVSKSFIALIPGFAVIGSIWAARLLIEMTPFESLHNVVNVLLGTPLSVLGGSLGGSLIAETVKMLLWSCGLHGANIVGGVMSPIWYGAMDENRLAFQAGEALPNIFTTQFFEIWINIGGSGATLALVITMFLRARSKQMKQLGRLAIGPAVFNINEPIIFGMPIVMNPMLLIPFIVSPLLMITATYIGMSTGLVAKPAGIAVPWTMPPGFSGYLATGGKISGAVMQLINLLISFVVYYPFFRMWDKQKLKEESELETGTAASDGQQVSV

SEQ ID NO: 8117 - protein, 101 aa, Bacillus licheniformis
MNILLACAAGMSTSLLVTKMEKSAEEQGKDYKIWAVSGGEVQNHIDKADVLLLGPQVRYMLPQLKKLGESKGVSVDVINTVHYGTCNGAEVLKSAEQLAGS

SEQ ID NO: 8118 - protein, 649 aa, Bacillus licheniformis
MLNARLKLILGELIGAESPLTSAYLANELNVTSRTIRSDVKELDRLLSKNGAAVQSIRGAGYRLSIKNDRLFRQLLQHTFHQELSTPVFPNERILYLLKRLLLTEEYVKLEDLAAEMYISKSTVQNDMRDVKKRLKPYDIELKIKPNYGFKLKGDEMKLRSCIAEHLFPKRETDIDIMNTRISILPKEELAMIRQTILEKISEDQISLSDIGLNNLLIHVAIACKRIRSGKHVSLYSKDVKEIMNHKEYEVARAIVRTLEQKLHVAFPEKETAYIAIHLLGAKRTVMAAIRSGAIESMMDEEETDRLTQLIMKTIDQKFTLGIGDDKELKIGLGLHLKPALNRCRYGMNIRNPMLDAIKANYPLAFEAGIQAGEVIKRETGFDIQESEVGYLALHIGAAMERRNMNRPSKRCMIVCASGAGSAMLLQDRLRATFGSKLEILGTVDYYKLNQMSLHALDFVISTIPLSDDLPIPVIQVNTILGGGDLTKIEQVLAEDDGIASTYTRKELVFLRESLSSREDVLRFLCGKVTQSGLADAGLEASVFEREAVAPTCFGNLVAIPHPMTPKTASTFWAVCTLQKPIVWENKRVQFVCLLCVEKDNTANLQEMYKFLGRVLDDRAIVRELLKCKTYGEFMSVFKKSGPAHRYAK

SEQ ID NO: 8119 - protein, 35 aa, Bacillus licheniformis
MKKMIKSAVKWAPVIYPIAWKIIKNRREKKNLKAG

SEQ ID NO: 8120 - protein, 196 aa, Bacillus licheniformis
MNPAHEPLPLEFYNKPTIELARSLLGCLLVKETEEGPASGYIVETEAYKGPGDRAAHSYGNRRTKRTEIMYREAGVVYTYTMHTHTLINVVSGGADEPEAVLIRALEPHEGLALMEKRRSGKKPRDWTNGPGKLTKALSITMNDYGRPLTGPPLYIAKGYEPQDILSGPRIGIDNSGEAREYPWRFWIKGNRYVSR

SEQ ID NO: 8121 - protein, 223 aa, Bacillus licheniformis
MHSSNPVKRQSASDYAYNELRTKIIELEYPPSEQLAEDSLAKGLNISRTPLRQALYRLELEGLVSKQPNGRLRVCPISLAEAKEVFKVREALEGLLTAEAAQLVTPESLHQLEDRIELMKLAAVKGRKTDTVKYGSEFHSILHAISTNATAKRFLDQLESRIERYRRISGYKNPDYKPSVSFNEHLDIFNAVKEKNSVLAEAAMRSHIKRSLRSIEETLERSY

SEQ ID NO: 8122 - protein, 371 aa, Bacillus licheniformis
MGKQGVFKPGLEGVIAGETNISFLDTEAEQIVIKGYDLIELAEQKTYLDLVYLLLQDKLPDPMELKGIESALKSAYELPGGIYTILKSLPNNTHPMDALRTGISALAGYDPELNDRSQAANRSKALRLIAQVPNITANSYRILHQKNVITPDKQLSFSQNFLYMLTEKEPTPQETAVFDQTLMLYSEHEMPNSTFAARVIASTNTDIYGAFTGAAASLKGHLHGGANEAVMYMLLEGETKSGFCKLIEHKLSRKEKIMGFGHRVYMRKMDPRAALLKKALYSLSHKTGRQDLYEMCDAGEKLMREEKGLYPNLDYYAAPVYYLLGIPIDLYTPIFFAARSVGLSAHVIEQHEDNRLFRPRVHYTGPRHLHP

SEQ ID NO: 8123 - protein, 479 aa, Bacillus licheniformis
MKTESQTLQNCDQLLEEIADYTVNAKISSEEAIETARYVLMDTLGCGILALKYPECAKHLGPIAPGTVVPNGTRVPGTQFELDPVHGAFNIGCMIRWLDYNDTWLAAEWGHPSDNLGAILACADYVSRQLLAAGKEPLTINDVLTAIVKAHEIQGVLALDNSLNRNGLDHVLFVKVASTAVACSLLGGTKQDVINAVSQAWVDNSSLRTYRHAPNTGSRKSWAAGDATSRGVRLAMMTLKGEMGYKTALSAPMWGFQDVLFGGKELTLARPLDSYVIENVLFKISYPAEFHAQTAAEAAIRLHPEVKDRLDDIGQIVITTHESAIRIIDKTGELHNPADRDHCLQYITAIGLIYGDITADHYEDETAQNPEIDRLREKMTTVENKQYSVDYLDPEKRSIANAVQVFYKDGTHSEKIAVEYPIGHRRRRNEGIPLLKDKFINNLKTRFPAGQAERINALLNDPHRLSGAPVPDFMELFVI

SEQ ID NO: 8124 - protein, 305 aa, Bacillus licheniformis
MWIVSKQSTQEELANAFRKLMKAPDILKIPGVHDGMAAITAKNIGFKALYLSGAAYTASRGLPDLGMIHSQEIAEKASELVRAANLPLLVDIDTGYGGVLNAARTAAEMAESRVAAVQIEDQQLPKKCGHLNGKTLVPAEDMIAKIRAIKETAPSLVVVARTDAKAAEGMEAAVRRANLYADAGADAIFPEALTSAAEFREMASSIKAPLLANMTEFGKTPYYTADEFQMLGCSMIIYPVTSLRAAAKAYERVFAEIFEKGTQKGVLDDMQTREELYDAIHYYDYEKLDENIAKTVLPEIGKEHR

SEQ ID NO: 8125 - protein, 397 aa, Bacillus licheniformis
MTKHKADRSLKSLLEILFVSTRLGLTSFGGPIAHLGYFHAEYVRKRKWMDEKNYADLVALCQFLPGPASSQVGIGIGVMRAGVLGGISAFIGFTLPSVIALVLFAMVLQGFDIGTAGWIHGLKIVAVAVVAHAVMGMAQKLTPDKRRKAIALFALVATLLWQTAFTQVGVILLAAFAGYLIYKEQVETDDSVMQFPVSRRFAAVCLSLFFGLLILLPVLREMTSSGWIAMFDSFYRSGSLVFGGGHVVLPLLEREFVPAGWLSEEAFLAGYGAAQAVPGPLFTFAAYLGAVISGWQGGLLATAAIFLPAFLLILGTLPFWDTLRRNPKVKGALMGVNAAVVGILISAFYHPIWTSSVLAPIDFAFAAVLFSLLVYWKLSPWIIVAAGAVGGAMLQLL

SEQ ID NO: 8126 - protein, 102 aa, Bacillus licheniformis
MEDKVLRKLFLGFIQIHILHHASEHPIFGLWMLEELKEHGYNISAGTLYPILHSMEADGLLRKEEQNVDGKIRKYYSTTEKGASVLKEARLKAYELFKEIKE

SEQ ID NO: 8127 - protein, 571 aa, Bacillus licheniformis
MIRRFFSYYKPHKRLFFIDFSSAIVVAVLELAFPLVVQWFIDTLIPGGDWLEIVWVSIGLLLIYLLSTGLQYIVNYLGHKLGINIETDMRQELFQHVQRQSFRYFDNTKTGHIISRITNDLFDIGELAHHGPEDLFIAVMTFLGAFWIMLTINVKLALVAVLFVPLLIILIIYSNIRMNRAWRQMYSEIADVNARVEDSVSGVRVVQSFTNERFEISRFLKNNQKFRKAKLKGYKTMALTTAGTFLMTRLMILAVLVFGAWLSFSGNMSYGEFVGFVLYVNVLFKPIDKISAILELYPKGMAGFKRFTELIDTKPQIVDRKDAIDVPALEGNIVFKNVTFGYEKHKPVLRGIDLSIKAGETVAFVGPSGAGKTTISSLIPRFYDIDGGAITIDGIDIRDMTKRSLRSQIGIVQQDVFLFTGTLRENIAYGKLDATDEEIQRAAKMAHLEQLIESLPDGYETQVGERGLKLSGGQKQRIAIARMFLKNPPILILDEATSALDTETEQVIQNALTELAKDRTTLVIAHRLATIRNADRIVVVTENGIAEEGTHDELVERGGIFANLHRVQYQS

SEQ ID NO: 8128 - protein, 219 aa, Bacillus licheniformis
MRDIQLFLAGDSTVCDYDENRAPRAGWGQKIGEFLSAGVLIRNEAASGRSSKSFIEEGRLKRIITQIKSGDYLFVQFGHNDQKPDDRYTEPYTTYKQHLTRYIDEARLKKANPVLITPVQRRSFASDGRFKNTHGDYPDAMIQLAEELRVPLIDLAFKSRQLLESLGPEASKKLYLWLEPGEHPNYPDGARDDTHFCDFGAKEIAKLVAQEAKEAGIPL

SEQ ID NO: 8129 - protein, 175 aa, Bacillus licheniformis
MFSFIIPTQGANAQEVKTNHFRGPIFCPPPFKPAPKPQPPQKPQPDNPQPDNPTQKPVLEAKTINSNKEWSTSDIEITYRPNAFVGSSYVEFHFPYRFHASTRDTLNGKTLDYTQILNDGQTVRVPVYALSSSEFKLVMVRKTLPNAGTHRITAELQQNGKNINHAETTLEIVPR

SEQ ID NO: 8130 - protein, 157 aa, Bacillus licheniformis
MLKRKFIGKIGVGLLTSAALFSFILPTEEASATFYRNAPTLHVETVDSNKEWTTSDIEVTYKPNFFVGSSYVEFNFPYRFHANTRDSLNGRTLNYTQILNDGQTVRVPVYAFSSSEFKLVMVRKTLPNAGTHRITAELQKFGRNYNHAEATVDILPR

SEQ ID NO: 8131 - protein, 409 aa, Bacillus licheniformis
MGTLNSQADLAAHSKAKPNRVWIAVILGILSGIGPVVIDLYLPGLPQMATDLHTNASVVQLSLTSCLLGLAIGQIVIGPFSDVLGRRLPLIVSLSVFAAASFLCAMTSSVWVLIAMRFIQGAAGAGGIVISRAIARDLYSGTELTKFFSLLMLVNGIAPIISPVAGGQLMKWTTWNGVFFIIGLFGLLMILSVIFGVKESLSPENRTAGGFKETFVSFGRLFGQRTFMGYALAQGLIVAGMFGYISASPFVLQDIYKLSAQAFSFCFALNGLGIIIAAQITGRLAGRFGEASLLRSGLLLSFTASVVLFVSVFFKAPLILILIPLFVVVSCIGIVTTTSGSLAMQSQGKSAGSASALLGLLPFILGAAAAPLVGIAGSHTALPMAVVILFCNISALACFNILVRRAALK

SEQ ID NO: 8132 - protein, 258 aa, Bacillus licheniformis
MNSFFMLFQKEWTERWRDGKLLWLPVILILLGLIQPLSLYYMPQIIDMAGNLPEGSVIDIPRPRGEEVMASTLSQFGTVGTAIFVFSVMGSIVHERNQGSLSLVMARPVSPLQYIGSKWLQQVLLVLVSFAASYGLAFYYTNLLFGKVEFDRFLFSLSVYSIWIIFVMSVTMFFSALFRHIGGIAGMSICFIAFVSLAGSLFPRFTEWMPDKAKSQADYFIMHGSWDHAFGWMVFSSLGIVILLFMCTVFVFKRYESY

SEQ ID NO: 8133 - protein, 295 aa, Bacillus licheniformis
MLSVNGLTKMYQQHQAVQNVSFDLEYQQCVALLGPNGAGKTTTLQMLSGLLAPTSGRIRFLGRESINRLEIGYLPQHPAFFSWMTALEYTVFAARLSKMKRREALEKSRTALRYVGLEKEEDRKIGGFSGGMKQRLGLAQALVHEQRLLILDEPVSALDPAGRREVLDMMKDLKKKMTILFSTHVLHDAEEVCDQVIMLKEGAVKWSGPLHRLKNRHLKPSYMLTAEESLEGWLEHLPYVSKVVYHKPSQAEFYLTDRSDSRRLLAECLNRQVSIVRFEQKTMSLEDMYLKVMGL

SEQ ID NO: 8134 - protein, 70 aa, Bacillus licheniformis
MTGADIPWALLAPFIVLSFILAVSALVSCIKQEKTNGPKWMWILIIFGISFVGPVSYFIIGKKTYERRRV

SEQ ID NO: 8135 - protein, 73 aa, Bacillus licheniformis
MNLDMTQEKLLLLLLCISPLLFAQSIFLFLNAKKKGANAWFWGIWGLIQTPMPLLFYYLFVVRPFHKKRRPLS

SEQ ID NO: 8136 - protein, 107 aa, Bacillus licheniformis
MNERDEKETVTHLKRELERIDDNFVPPVPQAFELNQRLARFKQERKRALKKELLCFIVMALVILSAYLTISVQVPAVFIMVQGAALILLPALALIEKRRHTADEEAD

SEQ ID NO: 8137 - protein, 177 aa, Bacillus licheniformis
MDQADEKELIIRAKDGEDAAFTKLFQLHYPFVYQYVLKLTLNPDLTEDLVQETMLKAYVSLHQFQGNAKFSTWLISIASRLFIDHQRRKKRENRKTQAAGEEALRKMKWNSALHGHEWSEYLEMFAALEPEFRMPILLRHYYGFTYPEVANMLKIKEGTVKSRVHHGLKKIRKEWGQ

SEQ ID NO: 8138 - protein, 417 aa, Bacillus licheniformis
MERQKQIVYEEKQILRKDHMIFWGAVFCFWFATYIYVPVFGLYLDNIGFSYSAIGIVLGSYGVTQILLRFPFGILSDVLSPLRKQLLISGFAMSLLSCCIFLLSDSFIMVITARLLAGMTAAMWVMATVLYSQYFTKDQSSKAMGILQFLTVLPQFISMAVSGYLVHLFGWMFPFWIGVAVSCIGLILSFYIKDNGPRHTAKGMALSDYVKQTLRLPDLKAITTLSFLAHAVLFMTVFGFTPIYAESVGIDEKQLIWVMFAFFVPQTLASVWCIFYKVKAADALIWISYVITAVFFCLLPFAETLFAVCIVHAVTGLTLGFIFPLLVSKVVQLGTPQLKMSVMGFYQSFYALGFFLGPVVAGKVAELFGLPKVFWFAGALSLAAACIMLFSKQFRIFTAGRRDKSSNIVQPTKVFRK

SEQ ID NO: 8139 - protein, 532 aa, Bacillus licheniformis
MDQHSNEQKSDMETDDTLTNRQGHPITNNQNIRTVGNRGPSTLENYDFLEKISHFDRERVPERVVHARGAGAHGYFEAYGTAGDEPVSKYTRAKLFQEKGKRTPVFVRFSTVTHGISSPETLRDPRGFAVKFYTEDGNWDLVGNNLKIFFIRDAVKFPDLIHAFKPDPVTNLQDGERIFDFISNTPEAMHMITFLFSPWGIPANYRQMQGSGVNTYKWVNQEGEAVLVKYHWEPKQGIKNLTQKEAEEIQAKNFNHATQDLYEAIERGDYPEWELFVQIMSDDEHPELDFDPLDDTKLWPEDQFPWLPVGKMVLNKNPEDYFTEVEQAAFGTGVLVDGLDFSDDKMLQGRTFSYSDTQRYRVGANYLQLPINAPKKRVATNQRGGQMQYKVDLGKNQSPHINYEPSTINGLKEAKQDGKEYTPHVEGNLVRESIDRQNNFKQAGDTYRHFEDWEKDELITNLVNTLAPCDQRIQTKMIDMLKQCDKEYGSRVEEGLKNASSQNTSSREPIGAEGAEDAPRQAEEKGHSQDPY

SEQ ID NO: 8140 - protein, 485 aa, Bacillus licheniformis
MTTNKNNLTTSWGAPVGDNQNSMTAGSRGPTLIQDVHLLEKLAHFNRERVPERVVHAKGAGAHGYFEVTNDVSKYTKAKFLSEVGKRTPLFVRFSTVAGENGSADSVRDPRGFAVKFYTEEGNYDLVGNNTPVFFIRDAIKFPDFIHTQKRHPVTHLKNPDAVWDFWSLSPESLHQVTILMSDRGIPATYRHMHGFGSHTFKWVNAEGEGVWIKYHFKTEQGIKNLTEEVGTKIAGENPDYHTQDLYEAIEKGDFPAWKLYVQIMPLEDADTYRFDPFDVTKVWSQKDYPLIEVGRMVLNRNPENYFAEVEQATFSPGTLVPGIEPSPDKMLQGRLFAYADAHRYRVGANHNSLPINRPKAEVHNYQRDGQMRFDSNGGGSVYYEPNSFGGPQETPENKTTAYPVSGSADSTAYDHNDHYTQAGDLYRLLSEEERTRLVSNIVGSMKQVTKDEIKLRQIQHFYKADPEYGTRVAEGLGLSVPQEV

SEQ ID NO: 8141 - protein, 138 aa, Bacillus licheniformis
MEDEQLVPLLKKRGLRITAQRVLILKTIASLGGHPSAEDIHRELPYMSLPTIYSNLKLFVKLGILKELSHGDAKSKYELFTSQHYHVICKSCGKIADLDYPHLKEVEHAAAQLTNFKVNSHFLGIYGICTTCQEQQQR

SEQ ID NO: 8142 - protein, 317 aa, Bacillus licheniformis
MERKKVGLLVMAYGTPYQEEDIIPYYTHIRHGKRPSDDMIEDLKKRYKHIGGISPLAKITLAQAKELEKTLNERQDKVEYVMYLGLKHISPFIEDAVEQMKKDQIEEAVSVVLAPHYSTFSTEVYNRRAKQAAAAIGGPRIASIDEWYQEEGFIRYWSEEIGSILNDMSEKEREKAAVIFSAHSLPEKIREHGDPYPDQLEKTAQLIGERLSFDQIAVGWQSEGNTPDPWLGPDVQDLTKELYEEGFRSFIYAPVGFVSDHLEVLYDNDYECKVVTDELGASYHRPPMPNTDPRFIDTLASVVERTYNSTEQEKAEL

SEQ ID NO: 8143 - protein, 313 aa, Bacillus licheniformis
MRVLKNELYRLMVTKSTWIVLSLLLVMTIAVAWMVSNGEKEKETGNWKEQLTVQNAQYEREMRELSPAVPKYQFLKEEIAVNQYRLEHNLPPSAKYNVWTMLKELKPITTLIALIAIVLAANSIALEHSKGTIKFAIATPVKRWHYLLGKYLSILLNTVFMFAATLLFAFVLGYALLGLEGSQYYLSYRSGEVIKMSMLKFLALDYGAALLNIIVLATLAFMISVILRSAVVSVGLSLFVFFTGSAITQFLAAKFDWTKYTIFANSDLSQYIDGEPFIQDMTLSFSAAVIAVYFILFLAVSFWVFQKRDIVTS

SEQ ID NO: 8144 - protein, 300 aa, Bacillus licheniformis
MSQVEFEGVSKRIKGRPIVQNITFQIAPGTIFGLLGPNGAGKTTLIKMIVGMAKPTSGDIRIDGYSVKSNYEEAAARVGSVVENPSFYEHLTGYQNLKYLGGFHSHVSKERIEEIVQLVDLTGSIHKPVKTYSLGMKQRLGLAVALLHDPEFLILDEPTNGLDPQGIIDLREHLQYLAKTFNKTILISSHLLSEVEMICDEYGVMKNGELLQIKSNHRDTDTVRYRLTLNGHADEAADLLNEYQYAGGLTEDKNEIYVLCMEEDIMKVVNLLMENKIRVLHMKQEKQSIEQSFLELINKG

SEQ ID NO: 8145 - protein, 249 aa, Bacillus licheniformis
MKNLLKAEWIKLRNSDFTMTSIFILTASLVFTGFMAKRITPFAGGNEWTSLRHLTLLLVFSTIYPWLVSSVTVFLHKDELKNRVWLNRILSPQPFAAMLFAKVLFIGLFAAALYAVCVIESLAFGLISGFPGPAPWFSWMKGFILNLLSTFPLICTVLWLKFTSKEKTSLNIIVFICSLLSFGVSQSPLGLLFPWSFPVTALIAMEKSVAVLIGSIVWFTAVSQLFFSLLLKQIRPYQKGGIQNESSRI

SEQ ID NO: 8146 - protein, 218 aa, Bacillus licheniformis
MKFQTFACTVMIITVLAVLLNYLLFYKNGANKEIRSMEGMAVYVVSVWLTYITGRRLFGRMMHQAFILRYPVRLFTWVLTGIAVITIVSALVLLYGCLAVSLLFQKDVLFSPERLAAVAILAVIMSSVQFFLKTLKAEYLFVLLMTLTPFFMQSGTLYLPWGVSWLLLTEYSVNDIGLAVYLISAGYIAVCMCWILRSGEEKIREKFAQSGMDQTQEL

SEQ ID NO: 8147 - protein, 211 aa, Bacillus licheniformis
MVELPIVMNHVEVRAGDRKLLENVSLAVDKGSRVLLKGENGSGKSTFLKAITGLSLFAGEILIYGQSIIQNREAAVGHIGYVSDEVPLHEHLTGTDNLRVHALLHGIDDDDRIYSELERFGINPADDTKVQYYSTGMRQKLKIAMALFHQPSILILDEPLNGLDRKAQESVVDIIRRYDGTIMASSHWNETFIELFDRFLAIESGRLNEIV

SEQ ID NO: 8148 - protein, 95 aa, Bacillus licheniformis
MLEMINSIGAVAGFAGFIGIIILISLDGKDERGAYIQNKFFRVMFFLLTLGISAVIFTSSWVDLSFANYKNMVTLAFSLPYFIGFFILLGIRSRV

SEQ ID NO: 8149 - protein, 92 aa, Bacillus licheniformis
MYSIYVNDLQIKRVIEIEKQSGVLTNRIPVLRAEKGWTQKQLADLLGVTRQTVISIEKNKYKPSLLMGFRIAALFEKDINEVFQYQLEEDDR

SEQ ID NO: 8150 - protein, 62 aa, Bacillus licheniformis
MYEYQTVSIAVGAFNGKLEKNYSDVIHEYAEKGWKLHSVFSVPSRAGGQVSSIELIFEKPKS

SEQ ID NO: 8151 - protein, 443 aa, Bacillus licheniformis
MKRIYIFLLCFAVLLPVGGKTAQAKEQAGEQYLLLEHVKDKSKLLDTAEQFHIHADVIEEIGFAKVTGEKQKLAPFTKKLAEKVGADVIEKPIANTAVNETESVISGSPAWGLDGILELKEYLWFAAKQTDSYRTYQIERGHPDVKVALIDSGLDLDHPDLKASVNTNGGWNYIDGKPVSGDPTGHGTQTAGMINIIAPDVTITPYQVLDEKGGDSYNIMKAMVDAVNDGHEVINISTGSYTSLDREGKVLMKAYQRAANYAAKHQVLVFSSAGNKGVNLDEMRKTENKVHLPSALKHVVSVGSNMKSNNISPYSNQGREIEFTAPGGYLGETYDQDGMVRVTDLVLTTYPKGKDNTALDQMLNIPKGYSLSYGTSLAAPQVAGTAALVISEYRERHHRKPSAKQVHHILRKSALDLGKPGKDVIYGYGEVRAYQALKMMNKE

SEQ ID NO: 8152 - protein, 718 aa, Bacillus licheniformis
MFFHKTPFIEQMQQTECGLCCMAMVAGRYGSHHTLHELRDLSGCGRDGMTLFHMRQLSENLGFDAKVYRAGAAELPHVRLPAIAFWSDNHYVVIDQIKDRHVNIIDPAIGRKKLSIEAFLENYSGIVLEMIPTERIRPKKKPPVWRHFLFHLKESPSLLATVLLFAMIFQLVSLGIPMLVQYLIDDILAQNQQALLQTFMTGVLVLMLVQGTVQLIRGQFIIKLNNFLDKRMMRTFFSHILKLPYQFFQLRSFGDLLFRATSLRIVRDMMSSQLVLGVLDFGALLFISFYMFYKSPPLAGLVILLALLNVGITALSRGKLREKNQDEIAKTSQIQSYQTEFLYGIFGIKTAGIEKETYQKWDHYLGELIGAYRRKEGFLNIVNSLTGTMQIISPMLILWIGAMLVFEGNLSVGELVAFHALSTQFFNTSSSIVQTVNSVILTTSYLHRIQDILQSPIEETPGNKDNSPIKGEIRLERVSFRYSPHSEEVIKDVSLHIKPGEKIAIVGQSGSGKSTLAKLILGLYMPTKGSVFYDGVNIKNKDLSALRKQIGVVPQDVTLFNRSIKDNISLYSEDVDIERIHEVAKMAQIYDDIQNMPMGFNTMISEMGMNISGGQRQRIALARALLNRPAVMLLDEATSSLDHQNEKKIDAFLRELKCTRIVIAHKLTSIMDADKIIVLEDGMVLNVGTHETLLNESKFYGDFYRKFLEKEQSAEVMM

SEQ ID NO: 8153 - protein, 1026 aa, Bacillus licheniformis
MSMKEFEIYLYKALYSNERGGQGQEHPSGFFPENGKTPSRPTDFHLSSVQHSPNEPVQLQGKMPEWAACLSEIMKYNPKAVSELKHPLPHMSFVTFLVPFLLFAQERMSKAFSEFEKQEGGLSGIIDAAGYQDGIMSELHQCLDKLATRTLITELNVAREDGRLKGASPEERYVYFVEQYISDPEIYREFFELYPVLGRLMAEKVLRVLEIHEEIIGRFLSDRSLIAKKFNIASPELVGFEGDLGDSHKNGQSVKVLVLNNGKLVYKPRSLSIDEHYRELLNWLNGRGMKYSLRAAEVLDRGNYGWQEFVKHEGCSSEEELERFYFRQGGHLAILYGLRSVDFHNENIIASGEHPILIDLETLFDNHVSIFAQNQNLHVTALELKHSVLSSMMLPVKFKHDEVLDFDLSGIGGKGGQQSKKAKGYAVLNYGEDRMSLKETSLTTEEKLNAPKLNGRPVSAVFYTDFIVEGFKNAYAIMMKHKEELAGPSGFLNLFKHDEVRHVFRPTHVYGKFLEASTHPDYLTAGDKREQLFDYMWMLAKQSEKANVFIPDEIVDLLLHDIPYFTFYAGGTSLLNSRGEESEGFYETSSIDLAKKKIQSFSEKDLNHQLRYISLSMATLIENVWDHAESGLGQKETVADLGKEVKHIADDLLQKAIYSERGEGPFWISNNAGDEKMVFLSPLPMGLYDGMAGLAIFFAQAGKVLNEQVYTDTARSMIEEIQKEESYWVQNGNSHSAFFGTGSFIYLYSYLGSLWEDDSLLERALNLIPRVLDQPNQTQNPDFIAGDSGLLTVLVNLYEIKQHPAVLDSIRQVLSRLNDRIGRLLDSIEQDAVSLTGFSHGLTGIAFSIAKAAKVIHDDSCKELVLKLVEEEDRYFQKDHLNWLDLRNDSHTLSPSYWCHGAPGILLGRAHIQAFIPELTTRTLKLQEALQSSLNLADCQNHSLCHGLIGNLNILLDIKRLNRELHVPDDIFCIYKTKNRGWKTGLHSDVESLGMFVGTAGIAYGLLRLLDESVPSVLTLDIPTGR

SEQ ID NO: 8154 - protein, 74 aa, Bacillus licheniformis
MSKKEMILSWKNPMYRTESSYHPAGNILKELQEEEQHSIAGGTITLSTCAILSKPLGNNGYLCTVTKECMPSCN

SEQ ID NO: 8155 - protein, 1052 aa, Bacillus licheniformis
MNEKSAGYHERLPVAQTQSPLVNDKIKYWRSLFGDDDKWLNKAVSLLSHDPLSSIAQSSVSQSVGLKDSRRGPWQKMQKRIFETPFSYKDSALQDSELLFDSLLTRFASAAQDALEEQNIILSPPLCRQVLTHLKQTLLQIAHQTLILELNILRLEDQLKGDTPEMRYLDFNDNFLVNPGYLRTLFNEYPVLLRLLCTKTDYWVQNFSELWKRLRQDREQLQAAFHIAGDPVHIELGVGDSHNKGKMAAILTYSDGKKIVYKPRSHDVDDAFQLLLSWINDRNSGSPLKTLRLINKKRYGWSEFIPHETCHTKKELEGYYTRLGKLLAVLYSIDAVDFHHENIIASGEHPVLIDLESIFHQYKKRDEPGSTAVDKANYILSRSVRSTGILPFNLYFGRKNRDKVVDISGMGGQEAQESPFQALQIKGFFRDDIRLEHDRFEIGEAKNLPTLDHQHVPVADYLHCIIEGFSAVYRLISDHGESYLATIEHFKNCTVRNILKPTAHYASLLNKSYHPDFLRDAVDREVFLCRVEKFEDADTDIAAAKTELKELIRGDIPYFLSKPSDTYLLNGEEEPIAAYFETPSFTRVIKKISSFSDQDLKEQANVIRMSILAAYNARHEKDAIDIDQNHPSPRSGALQPLAIAEKAADDLAEKRIEGNDGKDVTWISTVIEGVEEISWTISPVSLDLYNGNAGIGLFMSYLSRFAKRPETYSHITEQCVFAIQRALNELKEKEEFLKYADSGAFTGVSGYLYFLQHAGTVQKKNEWIELIHEALPVLEAVIEQDENCDIISGSAGALMVLMSLYEQLDDPVFLKLAEKCAGHLLQHKTNIENGAAWKDPHTQNYYTGFAHGTSGIAAALSRFNKVFDSQSLKKIISQCLAFEKQLYIASEKNWGSKGREQLSVAWCHGAAGILLSRSILRENGVNDPGLHTDILNALETTVKHGLGNNRSFCHGDFGQLEILRGFREEFSELNTIIQNTEDRLLTYFQENPFSKGVSRGVDSAGLMLGLSGVGYGMLQCQYGEELPELLQLSPPQALIKKNSKAFKRENVF

SEQ ID NO: 8156 - protein, 341 aa, Bacillus licheniformis
MKKLISIIFIFVLGVVGSLTAAVSAEAASALNSGKVNPLADFSLKGFAALNGGTTGGEGGQTVTVTTGDQLIAALKNKNANTPLKIYVNGTITTSNTSASKIDVKDVSNVSIVGSGTKGELKGIGIKIWRANNIIIRNLKIHEVASGDKDAIGIEGPSKNIWVDHNELYHSLNVDKDYYDGLFDVKRDAEYITFSWNYVHDGWKSMLMGSSDSDNYNRTITFHHNWFENLNSRVPSFRFGEGHIYNNYFNKIIDSGINSRMGARIRIENNLFENAKDPIVSWYSSSPGYWHVSNNKFVNSRGSMPTTSTTTYNPPYSYSLDNVDNVKSIVKQNAGVGKINP

SEQ ID NO: 8157 - protein, 283 aa, Bacillus licheniformis
MSAEQLPIWTKDCVKGSLPKRGNDSHKGTYGTGLLLAGSDDMPGAALLAGIGAMRSGLGKLVIGTCGSAIPLILPVLPEATYWRDGAEKAASGEIAEPYRAIAIGPGLPPSQMTEQAVQSVLAKDCPVVLDAGALSKRSYHEREAPVVLTPHPGEFSKMTGLSIREIEANRAGYARDYAEEQGITLVLKGNETIVAFPDGECWRNVTGNGALAKGGTGDTLTGMLLGMLCCHENSREAVLNAVHLHGACADAWTKTRSAHALLAHELSDLLPTVWKAYEDGNK

SEQ ID NO: 8158 - protein, 582 aa, Bacillus licheniformis
MNNEDGWILPYIKKNTRLLIIVVLLGGLTACSAAALMFTSGYLISKAATRPENVLMIYVPIVAVRTFGILRSVSRYVERLTGHHIILKILSDMRVRLYRMLEPQALKWRERFRTGDMLGILADDVEHLQDMYLRTVFPGLSALLLYGVFIAAIGFFSWPFAGLMAVYAAVFVFLVPLVSLLVTRAKNVALKRGRSHLYRQLTDAVMGVSDWVFSGRQNDFVHSYEAAEHEWLAIEKKQVRFSRWRDFAMQCLAAGLVLLMLIWAGGQSAEGALAPVFIAAFVLVVFPLTEAFFPLSDAAASIPEYQDSLERMDGLQPPKRGNGADVQQERAEAVGLDDVTLRFEDVSFSYEQGQPVLDGVSFILKQGEKTALLGPSGAGKSTILSLIQGALAPSKGNITLNDISVQSLQGEISRVVSVFNQQPHLFDTTVLNNIRLGNPDASDEDVYWAARQVKLHDYIQSLPDGYHTSVQETGIRFSGGERQRIALARILLQDAPIVVLDEPTVGLDPKTEKELLSTMFQVLDGKTVLWITHHLAGAEAADRILFLDKGKLAMAGSHQQLLENNPRYSRLYRLDAPVSRLF

SEQ ID NO: 8159 - protein, 574 aa, Bacillus licheniformis
MGKDLLQYKGMKRILAVLTVLTCMQGAAIIMQAEWLAEAVTRLFNGERVGSLFPLLILFTAAFLFRHAVTLVRQKLIFDYAAETGAGMRKKFLEKLFQSGPRLARKEGTGHVVTLAMEGIAQFRRYLELFLPKMVSMAVIPPAVVCYVFFKDTSSAAVLMITMPILITFMILLGYAAKRKADSQWKTYEMLSNHFTDSLRGLETLKVLGISRSHTKNIFHVSERYRKATMSTLKIAFLSSFALDFFTMLSVATVAVFLGLGLVDGSISLEPALAILILAPEFFLPVREVGNDYHATLNGREAGKAIKAILDSPGFKDEAPLSLERWSDDDQIEFKHVDVRHEDEENCSLSGISLSFKGKRKIGIIGESGAGKSTLIDVLGGFLETKSGVIKVGGKKRTHLQTDSWQNQLLYIPQHPYIFPDTLAANIRFYHPAASDEDVEQAARAAGLSELIDQLPNGLKERIGEGGRALSGGQAQRTAVARAFLGNRPIILLDEPTAHLDIETEYELKKTMLKLFEDKLVFLATHRLHWMLDMDEIIVLKDGQVAETGTHQELIEKRGVYYELVKAQSFGGAS

SEQ ID NO: 8160 - protein, 338 aa, Bacillus licheniformis
MVSLNEFWFILVAVLFIGFFFLEGFDFGVGMATRFLGRNDLERRVMINTIGPFWDANEVWLLTGGGAIFAAFPNWYATMFSGYYIPFVFVLLALIGRGVAFEFRGKVETAKWKNTWDWVVFFGSILPPFLFGVLFASILRGMPIDADMNLHAGFTDYVNVYSVTGGVAVTLLCLLHGLIFITLRTEADLRDRARQLAKKVVFAVLAALVAFVALSIFETDLFTGRGHVTIPLAALIVVCYVLSIVFMKQKRDGWTFAMTGAGIALTVATIFTALFPRVMISSVKSAYDLTVYNASSGDYSLKVMTIVALALLPFVLGYQIWSYYVFRKRVSSKEPMIY

SEQ ID NO: 8161 - protein, 468 aa, Bacillus licheniformis
MDELILARFQFASTTIFHFIFVPMSIGLVFMVALMETLYVAKKKDIYRTMAKFWGHLFLINFAVGVVTGILQEFQFGMNWSEYSRFVGDVFGAPLAVEALLAFFMESTFIGLWIFGWDRLPKKIHLLSIWLVSLGTIMSAFWILAANSFMQEPVGFAIKNGRAEMTDFFAIIKNPQLWVEFPHVIFGALATGAFFIAGVSAYKMLKKQELLFFKKSFQIAMIVALVSGGGVAFSGHEQAQHLMKSQPMKMAASEALWDDSGDPAAWTVLANIDTDKQENKSELSIPYALSYLAYKQFSGDVPGMKTLQKQYEEKYGEGNYIPPVKTTFWSFRIMAGSGLLMIVAALTGLYLSFRKRLETSKWFLRTMVALIAFPFIANTAGWIMTEIGRQPWTVFGILTTAQSVSPNVSAGMLLFSVIAFTAIYLVLALVLVYLFVREIKKGAAHHDHHHDDSVSTDPFDQEVYHGIS

SEQ ID NO: 8162 - protein, 262 aa, Bacillus licheniformis
MESKSLVLVEELALKKQSIFVQSPLRYLLRAMLASMFIGFGVIVAFKTGNLFYVEHSPFTYPIAAITFGGAIILIVYGGGDLFTGNTFYYTLAALRKKMRWPTVIKLWMFSYAGNLMGAVFFAGLIFATGLFKDPSSTGFILSVAEHKMNTPVTELFFKAILCNWLVCLAFFVPMAQKGDGAKMFSMMLFVFTFFISGYEHSIANMATFAVSLVTEHPETISIAGAIHNLIPVTLGNLVGGAFMMGFMYHYANKPGGEEIIK

SEQ ID NO: 8163 - protein, 109 aa, Bacillus licheniformis
MNHGVCSVSIKRNLRVAIQGRPSRGVGMEEIMFESLDQNGIALNMAEVAILPEEVPLFTKKLVDQGIIISALHNHWIFTEPNILYIHFQSVEPPLTFAKKTAAALSVLR

SEQ ID NO: 8164 - protein, 443 aa, Bacillus licheniformis
MNGNNIIRNLMLEIPSAPGNLGKVTTAIGLAGGDIGEIETIKVGPNYTMRNITVQVEHEEQLTEILEVIRNLKEGIHLHTVSDDVLAAHEGGKIRMKSKMPIRSLADLRRVYTPGVANVCELIKEEPQKANIYTGIGNSVAIVTDGTAILGLGDIGPVAGMPVMEGKAALFDQLADISGVPILLDTNDPDEIVRTVKNIAPGFSGILLEDIGSPHCFEIEERLKNDLNIPVMHDDQHGTAVVTLAAAISAAKSAGVDLKQAHVGQIGLGAAGVAICRMFMAYGVKRVVGTDKSLEAMARLENYGGHAAESIEELMESCDIVVATTGVPGLINKKWVREGQVILALSNPKPEIEPEDALEAGAAYAADGRSVNNVLGFPGIFRGVLNAGADSISHPMLVAAAEAIASCTRQGDLVPHPLNPEVHEIVAKAVERVALSEMGKING

SEQ ID NO: 8165 - protein, 465 aa, Bacillus licheniformis
MKTARLPSMLEIICVLGAFLAIVCSFTVKFELPIQLALFISWFLVILLGLRLGHRYEDLQKSITNGISNGLEAILILIAVGALIGTWIAGGVVPTLIYYGLEFIHPSIFLLATLIICSITSVATGTSWGTVGTAGIAMMAIGEGLGLPLPLVAGAVLSGAYFGDKLSPLSDSTVLASSLSKVEVITHVRAMLYLSIPAYLITAVLFTITGFMYGSRNVDLEKVEFLKASLQNTFDIHIWMLVPAVVVIVLLAMRKPSVPTIAIGALLGAIWAAVFQGMDFADAIGTAYNGFSIDTGIKFMDELLNRGGIEGMLGSVVVIILGLGFGGLLEHLGVLKVIVSKFQQKLTSAGNVTFSTIIVAFLANVFGCAMYVSLILTPKIMEKSYDKLGIDRRVLSRNAEVGGTMTSGMVPWSDNGIYMAGILGVSTFSYVPFMWLSFVSIGLAILYGYTGKFIWYTDKKDSPVQ

SEQ ID NO: 8166 - protein, 377 aa, Bacillus licheniformis
MKAEMTYRTEKDFLGEKKIPADVYYGIQTLRAAENFPITGYKIHEEMIKALAVVKKAAALANMETKRLYKGLGDAIVQAADEILEGKLHDQFIVDPIQGGAGTSMNMNANEVIGNRALELLGHNKGEYIHLSPNTHVNMSQSTNDVFPTAIHISTLKLLEKLLDTMEYMLDAFKKKARDFDHVIKMGRTHLQDAVPIRLGQEFEAYSRVIERDIKRIKQSRQHLYEVNMGATAVGTGLNADPRYIENVVKHLAEISGLPLVGADHLVDATQNTDAYTEVSAALKVCMMNMSKIANDLRLMASGPRAGLAEISLPARQPGSSIMPGKVNPVMAELINQIAFQVIGNDHTICLASEAGQLELNVMEPVLVFNLLHPSAS

SEQ ID NO: 8167 - protein, 329 aa, Bacillus licheniformis
MKKLLLLTTGGTIASVEGENGLAPGVKAEELLSYLSDDHSNYTIDCQSLMDIDSTNMQPEHWVMMAEAVYENYSRYDGFVITHGTDTMAYTSAALSYMLQNIDKPVAITGSQVPITFKKTDAKKNIKDAVRFACDGIGGVYVVFDGRVILGTRAIKLRTKSYDAFESINYPYIAFIHDKEIEYNKRVPEVKPGALKLDTSLNTDVCLVKLHPGLKPEFFDCLKGSYKGIVIESYGSGGIPFEKRNILEKVNELIDSGMVVAITTQCLEEGEDMSIYEVGRKVNQDAIIRSRNMNTEAIVPKLMWALGKNGQQAEVKKIMETPIADDIII

SEQ ID NO: 8168 - protein, 133 aa, Bacillus licheniformis
MNLDRLTTLRKNKKWSLQYTADRGLRVIWRKKAPLPSGADRLGIAKSTYAGYESGYRRPSLEALIEIADLFNTSTDFLLGRVDDPRDEKAKNEAIELTDWAKLKLAVDGTLLSEEEIKQMVAFIKVKKGLDAE

SEQ ID NO: 8169 - protein, 348 aa, Bacillus licheniformis
MAKYRGYIGTYTKADSVGIYTFELDTEKKALSTPKPAAKLGSPTYLNIAKDNDMLYAVVKDGDKGGVAAYRIDGSTGELTIVNQQTGEGPSPCHVSVDQDNRYVLSANYHNGTILAYPLNESRGLLEPSSKVQHEGSGPHERQEKAHTHYSGFSPDEKYAVAVDLGTDHIITYQLKEGRLEEVKKHAAAPGSGPRHIEFHPQEKYAYVLTELSNEVIVLEYNPDLGEFREIQVISALPEGFDGHSQGGAIHITKDGKFVYASNRGHDSIAVFSVNEYSGELSLVEHVSTEGEWPRDFEIDPSEQFLVASNQETGTLTLFERDRTTGRLTLLESGVPAPEAVCVKFLHQ

SEQ ID NO: 8170 - protein, 124 aa, Bacillus licheniformis
MTKIMIVEDSEDIRKLLRDHLEKYGYETVAATDFTSILEIFLQEKPDLALLDINLPAYDGYYWCRQIRQHSTCPIIFISARSGEMDQVMAIENGGDDYIEKPFSYEVVSLKLKAKFAGHLENTQ

SEQ ID NO: 8171 - protein, 326 aa, Bacillus licheniformis
MKLFLKNHAVLIFLFLFQGGFVFFYYWFAGMQTFTHLFYILGVQLLALALYLSYKWYEEHRVYQWIGSDQKDTEIPFLGTSEFCSELYEKHMELSRLHHRKIHDMESKLEDRVTYMNQWVHQVKTPLSVINLIIQEEDEPVFKQIKKEVQQIEYGLETLLYSSRLDLFERDFKIEAVSLDELLNSLIQRYKRYFIQHRVYPNKQVPAEDAVIYSDRKWLRFSTGQVITNAVKYSSGRSERIDLTIFRKGERIILEIKDYGIGIPSQDVKRVFEPYYTGENGRRFQESTGIGLYLVKEIAEKLNHDVSIDSEEGKETTVQFSFLTKM

SEQ ID NO: 8172 - protein, 258 aa, Bacillus licheniformis
MTTNMLVVKNINKTYKGQVSHQALKDISFNVEESEFTAIMGPSGSGKTTLLNIISTIDRPDSGDILIRGEDPHHLKRAKLAHFRRRQLGFVFQDFNLLDTLTIGENIMLPLTLENQPLSVMEDKLQAIAEKLGIEQLLNKRTFEVSGGQKQRAAIARAVIHQPALILADEPTGNLDSQASKDVMETMQHLNENDNATILMVTHDPVAASYCRRVIFIKDGTLFNEIYRGANRQVFYEEILNVLSMLGGNTNDLSSVRL

SEQ ID NO: 8173 - protein, 625 aa, Bacillus licheniformis
MTFLQFAYKNVVRNKRAYLAFFLSSSFSVMIFFTFAMFLFHPALEEGYLNTIAKRGLSVAEWMIFAFSILFVLYSVNAFLKSRSKEFGILTIQGIAPGQLRKLITAENIIIGVLSIVTGIIGGLVFAKTFFTIGAYILEMDALPLYLPWKAMALTSACFLALFILLSQFTVLFIKSKTVVKLIKGTGKIKPEPKPSIIFSVVGIGCLGSGYWLVLFADIHFPQAVTILILTIIGTYFFFSQSSIWLLRLLKKRRSFYLRGKNVLWISDLVYRLKDNARLFFLVCIISAVAFTAMGALVISKTSIGKLDSRYEIEYLLYSGSQKEQTHVKVIEQKLKDGHFSYAKEVTKGIYMSYSQGDLLPPVLLVSEGEFQKHFKLNSGELKDGEALYYPNAFEAKEKREIPETLDMLNKDLKPANERLKVKGIKKPLISLESIVVVNGKTFEKLKKQGESLTLYGYQYNRWKESLDMSQSLEKDLREKSHNIQFQFEAKAINYFETVQLPSLSLFIGFFIAVLFFTASGSFLYFRLFTDLEEDQERYRSLSKIGLSEKEMSQSVTIQLAILFFFPFVLASIHTYFAMKTLEAQSLGHFASPVIMTIGGFLIFQLLFFMMIRKSYLKKLKGFLR

SEQ ID NO: 8174 - protein, 116 aa, Bacillus licheniformis
MKKTISLITAALAVCIGAFLLIHNEVTDRFNPLVKKESVYVQINKDGKHLSPGRYEYTLEGYNDTGKEKEITFSASDSLRRNAYLKVNAKGKYVETWEEVQPGGMPSAVQKKLIKQ

SEQ ID NO: 8175 - protein, 279 aa, Bacillus licheniformis
MKKTKMLLVLSMLMGVLYGCSGHETKGEEKTEPNTAQKAAKQSKQQAEHDPSSKWVKVKSPARIPILMYHSISSGNSLRVPEGEFRGHMKWLKDNGYYTLTPEEAYIVLTQDKMPSDKCVLITFDDGYTDNFEKAYPILKGYGMKATIFMIGKSVGGKNHLTEKQMNEMRRNGISIQSHTIHHVELNGLAPGQQLDEMTRSKALFDRMFSQNTVMLSYPVGRYNEDTLKLAKQAGYQMAVTTEPGAASRDQGMYALHRVRISPGMSPDAFGKMVEHSRQ

SEQ ID NO: 8176 - protein, 209 aa, Bacillus licheniformis
MNGRLVALENPGYDGVRSVFLNHGCDIQPIGLETDGINLTQLAATRAKLVYITPSHQFPYGMVLPIQKRLKLLEWASREKAYIIEDDYDSEFRYQGRPIPSLKALDKKENVIYLGTFSKSFLPGARLSYIVLPSKLADEFQEKLGRYSQSASPIIQKAMFLFRKEGFFERHIRKMKKVYQEKHKTLISAIKTHFGNDVESSAKKRGSIF

SEQ ID NO: 8177 - protein, 752 aa, Bacillus licheniformis
MEFILHYYPAAMIALILIGFWGSRVNSRFKKFLIILCLMTNGVYIVWRFGFTLPVSRPADIVMGVILIATECIGFLQLLVFYTLVWKEKKREPEKLGDQDHRPSVDILIATYNEERHVLKKSVAGCLNLDYPKELVNIYLCDDGRRTAIQKLAEELGVHYVTRQNNEHAKAGNLNHAMSCSNGELIVTMDADMVPLPSFLQKTVGYFKKEKVAFVQTPQAFYNEDPYQYNLFSGANIPNEQDFFMRRLQAGKDRFNAVMYVGSNTVFRRTALEEIGGFATGVITEDMATGMLLQTKFKSVFVKEVLAVGLSPETWMDLLKQRDRWCRGNIQCGKKWNPLFLKGLTPMQRILYFDGILFWFFGVFKMVYILAPLMFLLFGIHSLKTDLWSITSFWLPAFLGSYLSFKAVSDRQRSMNWSHIYDTSMAPHMAISALSEFIFKKRFDFKVTPKGVNTDRRKFKYTTALPCAILLAMTLLALGKTLYELLFLHTFDINVTSYNLFWVLYNMTGLILALLVAFDRPRFRSSERFTVNKPAAFSTVSVDEHKCELIDVSDTGARIRLPYTADSDMYYHVDGLIIDAVGKVPARVMWTTKDEADIEIGLHFKEMDKELYVKLIGFMFNEENAKKADREKRADTLSTVIRFLTKTEKSPDAFKRKYVREAFQGLGTLLFPRDSEKGAHEVMIKDISLSGCQIESGFPLEINEHVLVSINEKDPDQRLALVCWIKKRRKRYTAGLKFLDEHASKSMGDPVA

SEQ ID NO: 8178 - protein, 450 aa, Bacillus licheniformis
MEAKTKVQHIPIQTTKEQDENFFARAMNVKIGIIPLPVYLLLFALIVTFVYMHDLKSDILTAIAVTGFFGFTFAQIGKSLPLLRSVGGAAILATFIPSAIVYYHLIPDDIIKSTTEFTENSNFLYLFISAIVVGSILGMKRETLVRAFIKIFIPLIAGTIAAAAVGLAVGTMLGLGFQHTLLYIVIPIMAGGVGEGAIPLSIGYSEIMHMSQGEAFALVIPSIMFGSLSAVILSGILNVIGKKKPELTGNGKVDRFDSGDAQPLESRDKDKESLFNLSHFASGGILAVSLYLVGMLSHDLFGFPAPVMMLLLAVALKLFRLAPANLENGAYGVSRFFSTAVTYPLLFAIGVSMTPWDKLIAAFNIANIITIVSVVVTMIAVGFFAGKWLNMYPIETAIINACHSGQGGTGDIAILSAAERLELMPFAQVSTRIGGAITVTLTLLLLAQFY

SEQ ID NO: 8179 - protein, 286 aa, Bacillus licheniformis
MSALFKKLMLSSLIGVSIGSALFAPNAGAQEPAVKPKKVDVIAHRGASGYAPENTMAAFDKALQMKADYIELDVQMSKDGELVIIHDTTVNRTTDIDSVLPVAVKDLTLAELRKLDAGSFFGPQFAGERIPTFEEVLDRYKGKVGMLIELKEPARYPGIEGKVSAALKERRMDKPKNGKIIVQSFDFNSVYKIHQLLPSMPTGVLTSKAADLTDAKLKEFSGYAKYVNANLKNVAADPTLVPRIHALGMKITPWTVRSRDEVPPLLKAGVDGIVTDFPDYVPKKVR

SEQ ID NO: 8180 - protein, 89 aa, Bacillus licheniformis
MKKIAAGLLSAGLIIGFSWGAGDVAEAKTKVKTYKNCKALNKDYKGGVARTKSVKNKGGKTKYKPYVSKALYDANKKLDRDKDKIACER

SEQ ID NO: 8181 - protein, 219 aa, Bacillus licheniformis
MKEDVRALTKSQYFFKLHPLMVPAGWKVKENHLYQKPIRDPRHTLLILENESCGKMVQVEYAGELKYVIRMQNADQSKVSEDSDAPYEQLIERLEDLMRASDGARNLLRLRIPAGWTVAHHSLTDTNPDELAPDSKAWLSDFKRDLLKLRHDEERLLLDVEWYPECSPAGHYALKLIKNGNWDSPLEDMLCIHPKELAYEINAVLKKTCEHQYVDETGA

SEQ ID NO: 8182 - protein, 639 aa, Bacillus licheniformis
MKKIFSHKLSFFVLAVVFVWAKTYASYFLEFNLGVKGSTQHMLLFINPLSFTIAALGLALFAKGRRSAIWIIIIDAVMTFALYANVLFYRFFDDFLTFANLKQAGNLGNMSDGVFDIMAFHDIVYFADLIILIALCVKLPELKASQLKKRWAAAVVLGGVALFFINLAVAETDRPELLTRTFDRNYIVKYLGPYNYMIYDGVQAAQNASQKAYASSDDLTSVINYTNSHYAKPNDEYFGAAKGKNIIKIHLESFQTFLIDYKLNGKEVTPFLNKLAHGQDDMMYFDNFFHQTGQGKTADAELMMDNSLYGLPEGSAFVTKGQNTYQSLPAILNQKEGYTSAVLHGDYKSFWNRDQVYKQIGYDKFFDASTYDMSEDNLVNLGLKDKPFFEESIPKLKSLKQPFYAHLISLTNHYPFILDEEDATLEKGTTGDKTVDGYFQTARYLDEALEDFFKELKKAGLFDDSVIVIYGDHNGISENHNRAMKEVLGKEITPYQNAMNQRVPLMIRIPGKKGGVNHTYGGEMDVMPTLLHLQGIDSKKYINFGTDLFSKDHDQTVAFRNGNYVTPKYTMIDTTVYDTKTGKEIKGNQETENLKSQVSEQLDLSDQVLYKDLLRFHEISDFKPVDPSKYHYGKEKTGE

SEQ ID NO: 8183 - protein, 185 aa, Bacillus licheniformis
MEQEKKQTFDVKSRMSFRVWVFAGTAGFGLIGAWLFYEAIKLESKYSLLYVGVGTFGVIYGLMTFLMVFPAFTKKGNIIFTIIEGEDGRIFSGKKSVLFKDIKSLKMAERRYSPKGIFLMDILIETRGNGRVRIPTYNILPEPEFYKAVELYILPYMTEEARAEWIGQFTEAQRKAYLNEFHKDI

SEQ ID NO: 8184 - protein, 278 aa, Bacillus licheniformis
MKKKAMDIILIIIGAFFFALAVNLFAIPNDLGEGGVTGITLILYYVFEWSPGITNFVLNGILLIIGYRFLDKKTTIYTIIAVAANSFFLHVTEDWTVPADEVIISTIFAGVFAGVGIGMIIRVGGTTAGSAILARIANKYFDWNISYALLMIDLVVVFSSYFIIGAEKLMFTIVMLYIATKVMDFIIEGLNTKKAITIISEHKNEIAAQVNTLMDRGVTILSGRGHYTGDSKEILYIVINKQELSMLKKIIRSTDKKAFVIIHDVRDVFGEGFVDISK

SEQ ID NO: 8185 - protein, 154 aa, Bacillus licheniformis
MFCLGGALMNKQKRQWLIKQTILEHPVENQEQLASLLEKRGITVSQSTISRDIKEMYLVKQPGENGKLVYTTNASLSINPSKILKDKISDVVLHVHRTDNLIIIKTMPGNAHAIGVLLDKLGSPEMLGCICGNDTCLVISQSPEAAQSFYDHLC

SEQ ID NO: 8186 - protein, 411 aa, Bacillus licheniformis
MTTPIHVYSEIGPLKTVMLKRPGRELENLTPEYLERLLFDDIPFLPAVQKEHDQFAETLKQQGAEVLYLEKLTAEALDDALVREQFIDELLTESKADINGAYDRLKEFLLTFDADSMVEQVMSGIRKNELEREKKSHLHELMEDHYPFYLDPMPNLYFTRDPAAAIGSGLTINKMKEPARRRESLFMRYIINHHPRFKGHEIPVWLDRDFKFNIEGGDELVLNEETVAIGVSERTTAQAIERLVRNLFQRQSRIRRVLAVEIPKSRAFMHLDTVFTMVDRDQFTIHPAIQGPEGDMRIFVLERGKTADEIHTTEEHNLPEVLKRTLGLSDVNLIFCGGGDEIASAREQWNDGSNTLAIAPGVVVTYDRNYISNECLREQGIKVIEIPSGELSRGRGGPRCMSMPLYREDVK

SEQ ID NO: 8187 - protein, 335 aa, Bacillus licheniformis
MNQTINLKGRSYLAEKDFSEEEILYLLDLAQKLKEKKAQGIRHRYLEGKNIALLFEKPSTRTRCAFTTACIDLGAHPEYLGKDDIQLGKKESIEDTAKVLGRMFDGIEFRGFEHEKVISLAEHSGVPVWNGLTDLWHPTQMLADFMTVKEHTGRVKGVKLTYIGDGRNNVANSLLIGGAKVGMDVRICSPQELFPDQDIVKMAEAFAEESGGKITVTSDTDKAVSGADVLYTDVWVSMGEEDKFAERIKLLKPYQVNMDLVKKTGNDNVIFLHCLPAFHDLHTTYGQNVYEQHGLKEMEVTDEVFRSKHSKVFDEAENRMHTIKAVMAATLGDLD

SEQ ID NO: 8188 - protein, 468 aa, Bacillus licheniformis
MAEEKKLGLFALIALVIGSMIGGGAFNLASDMASGAGAGAILIGWIITGVGMIALAFSFQNLTTKRPDLDGGIFTYAREGFGHFMGFNSGWGYWFAALLGNVAYGTLLFSAIGYFIPAFGDGQNIASIIGASVILWCVHFLILRGVQSAAMINLITTISKLVPIFAFIIAIIFVFHLDLFTNDFWGKGLSLGSIGTQVKSTMLVTVWVFTGIEGAVLFSSRAKKSSDVGKATVIGLISVLVIYVMITMLSLGVMNQQNLAELPNPSMAAIMEHIVGKWGAVLINLGLIISVLGAWLAWTLFAGELPLIAAREGVFPKWFGKENKNGAPTNALTLTNAIIQLFLLTFLISDAAYQFAFSLASSAILIPYLFSGLYQLKYSWLHKEPNRGKNLIIGIIASIYGVWLVYAAGLDYLLLTMILYAPGILVFRAVRKGKEGPVFNKAELLIAALILVLAVIAVIRLASGSISI

SEQ ID NO: 8189 - protein, 316 aa, Bacillus licheniformis
MKKRKIVVALGGNAIQTGDASAEAQKRALEETAMYLADMIDSGAELIITHGNGPQVGNLMIQQKEADSPKTPAMPLETCVSMTQGMIGYWLQNALDRALHAKGKGGHAATVITRVAVRSDDEAFRNPTKPIGPFYSEEEAKELMNSRNGGLVFKEDAGRGWRRVVPSPAPVSILEHDVINDLVEHGHIVIAAGGGGVPVIENGDAVSGIDAVIDKDFAACKLAELVQADELVILTGVDYVAVDYLKPTERALKRVTTEELKGYIKEKQFAEGSMLPKVKAAIQFAEAKKGNKTVITSLKLAKDALQGNAGTIVVQA

SEQ ID NO: 8190 - protein, 225 aa, Bacillus licheniformis
MKNKDIVHQLKKFPLLASLNKRDLEDMKQFIYWRSYHKGQILFMEDDPRERMYLLLDGFIKLEKSNEAGSMFYTDYVRPHTLFPFGGLFRDEHYHYAAEALTDIELYYIPMNIFEDLVRDNKNLLYDILNHLSDILALHEERLKRITLSHAHDRVTQAIYYLTESLGQKESNSTVINCPITAAEIAKISGTSRETVSAVLKKLRCEGVISQMNKQIMINRPEYFM

SEQ ID NO: 8191 - protein, 478 aa, Bacillus licheniformis
MARQTWKIPDDFILGAAASAWQTEGWDGKRPTQDSYLDMWYKNDPDVWHDGYGPAVATDFYNRYKEDIQYMKDIGLTHYRTSINWSRFLLDYETAEVDEVYAGYIDDVIDELKRCGVEPMLCLEHYEIPTVLLEQYGGWGSKHVVGLFAAYAEKAFERYGDRVKYWFTFNEPIVPQTRIYLDALRYPYEQNTKKWMQWNYHKALATAKAVAIFRKRKPSFREGAKIGVILNPEVAYARSSAPHDQKAAQVYDLFFNRVFLDPSIKGVYPDELMELMAKHDILFDHDEEELSVIKRNTVDFVGVNLYYPKRVQAPSRQWNESTPFHPAYYYEPFELPGRKMNPFRGWEICPRIVYDMAMRLKYEYGNIEWLIAENGMGVEHEERFKNEEGVIQDDYRIDFISAHLREAMKGIADGANCKGYMLWAFTDNVSPMNAFKNRYGLVEIRLENNRSRALKKSACFYRDIIKNRRFETEEFRYK

SEQ ID NO: 8192 - protein, 439 aa, Bacillus licheniformis
MSRMAKVTEMFERVAFKITSFKYIMVIKSAFVTLMPVIIAGAFAVLMQNMVMSPETGLAVFRPFRFLSALEPIMASINYATLNFITIGAVFLIGIELGKLNGHESFFPGLMALMSYISVIPSAVLLEVNGSMQEVVNVLAKEFTDPKSLFLGMFISIVSVEIFSKLSSMDRLKIKMPDSVPANVSVSFGTLFPSIITVTIIASFGFAFHRLTGVYLHEAVYNVVQKPLEGAIQGLPGILLLVFVAQFFWVIGIHGNQMVKPIREPLLLASITVNMNAYAAGESIPNIITMPFWDVYMSIGGSGVTIGLLIAMFIAGKREDLRSITKISFGPGIFNINEPVIFGVPVMLNPLMAIPFIVTPLVTGAIGYIATAAGFAGKAVVMVPWTTPPIINAWLSTGGSLGAVVTQIVCIIVSVLIYLPFVILLNRTFTISSEKNVSM

SEQ ID NO: 8193 - protein, 463 aa, Bacillus licheniformis
MDKQRFKNEVNKIDVPTKEIRESIDKGIKRAKREKTFRPKRAVKRTVFVSSAAAVLLLGSGFVSPAMQSVLADVPLIGKAYQQFHDYVGQNLVAGQLVTELNEKASSNNIDVTATSVYFDGGIIGMTFKVKSDTRKDLDDGARMIHFTLFNGERKWAIASQGDLKKTEDGYTGYIQVGYPDKHIPDKLTLPVTITNINGIRGKWKFDIPVDKLPYKTLHITKNNTQSADGHKLAVKTVILGKESTVIDYEVSNSEEHPNDRTSVIKVTDDKGNEIPYLSGGQWTTDSTKNGNKVRHEERLILGKVNKGTKHLKIEASSSMGDSEKTLPLTKTPAALSADRHDFQIAVDQVKQNGSKLSVDYHLKHVDQSKIDIDSMQNFLETMSLVDSAYKSIDEAPMGHSVKGNFTKVLDPKKLRFRSDFTLDGEFGAKNFSLDRYSLDVEFGYLSAFYSTPFKPIKVQLPQ

SEQ ID NO: 8194 - protein, 182 aa, Bacillus licheniformis
MKQIRLVKKAVAGNAKAFEMLFQKHSEQLYRTAYIYVRNKEDALDIVQETAYKAFLSIAQLRNPEYFLTWLTKILIHHAYAILDKKKKVVLMDRPLQDEGREQEMHADDRIGMLEAVQQLRKEYQTAIILFYYHDLPIHDIAEVMNAPEGTVKTYLKRAKLELKQLLTGGEDAWTNNGSKTK

SEQ ID NO: 8195 - protein, 209 aa, Bacillus licheniformis
MKIRIHRFLPLTEAEGPGKRACLWVQGCSVRCEGCGVPWTWSDKGGKDISVDDLFKKIVDSKKENNIEGVTFLGGEPMDQAEALAELADKIKIAGLSILTFSGRYLEDIKSNPRKGQLELLELTDLFIDGPFEKENIDLSRPWTGSSNQRYHFLTERYRYLEGQLQSISNKIEVRLEPDGTVSINGMIRQEQLQSLYEELSKHKVSNRN

SEQ ID NO: 8196 - protein, 221 aa, Bacillus licheniformis
MANGYTNKGVKWELFQSIWVLFVFTPFGFLNWVSFFYIFARAKQKKWLIAGWIYFAIFLFTILSNGTPLFNAAMVLLIIGWGVSIVHALKVRPEFLIRLESIQQLKRAEIDQLRKSLKNEYPETAAARTSQTDKQSERKIDINQASVEDIASIPQLGIILAKKAVAMREEIGGFSSIDHFGEQLGLKPHVLLKVEPYLSFSKPVDRRDRKDENAEGRVLDI

SEQ ID NO: 8197 - protein, 72 aa, Bacillus licheniformis
MSQRIIVEIQQDGQINVETKGIKGPKCRDYIRVLEQLLEAETIDSSYTAEYFETEQVDVLRHQQIIRGHRNG

SEQ ID NO: 8198 - protein, 147 aa, Bacillus licheniformis
MSIEIVLLPVAIAATQAIASYLAENESGRLYTMPTVMKDEDLLKKALDQNGCKTIELGTTNVEAIMEDSAVTFHLTEEGTFKAAFDRSVDKNQAREFIDQIEEEYKRILQQETYLKLIEKAEHEGLVLENETVTNENSVVLTFKVNG

SEQ ID NO: 8199 - protein, 554 aa, Bacillus licheniformis
MEGYHHFRKEVANYFRARFPFLYISTWEEERVIDQLSHIVSDTELIRTPRTLFVWSLTKGFESNGMPPSAETKDPLKALAFIEKYDQPAVFILKDFYVYLGANNRPPEYRLIRKMKDLVSVLEKSLVSKNVVLVAPTLTLPPELEKDITIVEFQLPSFAEIKETLKKMIEMNQGQNRAIVSLTEDEEERLVKAALGLTLKEAENAFALALVSKGRLDSDSVDQILFEKQQIIKKTGVLEFIKSEPNIQDVGGLENIKRWLNKRNKSWMDSAQDYGLPSPKGLLLTGVPGCGKSLIAKAVSSMWKLPLLKLDMGKIFSGIVGSSEENMRNALSTAEAISPSILWVDEIEKGLGNSGTAGDGGTSKRVLGNFLTWMQEKSKPVFVIATANNIDALPPEFLRKGRFDEIFFVDLPTKKERKEIFRIHLEKRLTNPKAAGNFSIEPPVLDKLAELTESFIGAEIEQVVISALFEAFSENRSLTVEDLEKVIKQTVPLAVTQSEQILAIREWASLRAVSAARQEDLKEYQSIQLKKDDENPRDKDADLHTSRGGRAVEF

SEQ ID NO: 8200 - protein, 410 aa, Bacillus licheniformis
MKNKLIERLISYAKVDTQSNENSQTTPSTPGQLALANMLVEELKEIGMKDVTIDENGYVMATLPSNTEKEVPTIGFLAHVDTATDFTGKNVNPQVIEQYDGKDIVLNESLNVVLSPKEFPELADYAGHTLITTDGTTLLGADNKAGISEIMTAMEYLIAHPEIKHGKIRVAFTPDEEIGRGPHKFDVEAFNAKFAYTVDGGPLGELQYESFNAAAAKITCKGTNVHPGTAKGKMVNAAKIAMQFHAALPENEAPEFTEGYEGFYHLLSIKGDVSETSLSYIIRDFDRDRFNERKDTVQKIANNLKAKYGENSVTVDMNDQYYNMREKIEPVKEIVDIAYKAMKNLDIEPVVKPIRGGTDGSQLSYMGLPCPNIFTGGENFHGKYEYISADNMVKAANVIVEIVKLFEERA

SEQ ID NO: 8201 - protein, 492 aa, Bacillus licheniformis
MNRIQQAEEALKKAGKKVNRRYRMGYHMMPRANWINDPNGLIQYKGEYHVFYQHHPYDENWGPMHWGHLKSKDLIHWEHLPVALAPGDEFDESGCFSGSAVEYNGDLALIYTGHNMIDEEKDDFYQTQNIAVSKDGIVFEKLKENPVIAEPPEDSARHFRDPKVWKHRENWYMVVGNSSKENVGRVILYRSPNFVDWEYVGVLAQSDGNLGFMWECPDFFELDGKHILLISPQGIEADGESYQNLYQTGYLIGDYDEETNEFVHGSFKELDHGHDFYAVQTLLDDKGRRIAIGWMDMWESEMPTKADGWCGALTLPRELTLKDGHKILMNPVEETKLLRGSEHHECDNQSISGSYFIKTAEKLLEVVAVFDLTICSAETVGLKIRGIEQEETTIKYSLIDQKLTLDCSKSGKARDGVRNVRLEADEKLTLHLFLDRSSIEVFANHGEATMTSRIYPKEGRAGIELFSEKGNVRVEEFTYWTLKDIWKGDEAK

SEQ ID NO: 8202 - protein, 411 aa, Bacillus licheniformis
MKSSNSLYWKLSAYFFFFFFTWSSSYSLFAIWLGQEINLNGSATGIIFSVNAIFTLCMQPLYGFISDKLGLKKNILFMISLLLVFTGPFYIFVYGPLLQYNVFLGAIVGGIYLGTAFLAGIGAIETFIEKVSRKYQFEYGRTRMWGSLGWAAATFFAGQLFNIDPNINFWVASASAIILVAIIVSVKIEMTDDEKERADSVGLKDVGGLFLLKDFWFLMLYVIGVTCVYGVYDQQFPLYYASLFPTAALGNQIFGYLNSFQVFIEAGMMFLAPFIVNKLGPKKSLILAGLLMAFRIIGSGLVSGPVGISSMKLIHALELPIMLIAMFKYLATNFDNRLSSVLYLVGFQFASQVGTSIFSPLAGGLYDSIGFRHTYLIMGAMVLCFTIISIFTLLDSKKDVEFAQNLQSNHI

SEQ ID NO: 8203 - protein, 282 aa, Bacillus licheniformis
MRRKFGPLTILEYICLVLLAALFIFPLIWMVASSMKPEADIYNNISSIKAFLPSFHPSEWFQSYREVLSRFDLLMYIGNSLFYGLCVAAGAVIINGMAGFAFAKLQFTGKKVLFTILLALLIVPMETILISQFTIVHKLGLVDTRLAVILPALAGAFNIYLFRNFFMAIPGEMIESAKLDGANTWQIFWRVMLPMSKPAVATVGTLAFIGSWNDYIWPLMVLTDKSKFPIQVAITAINSTEPVYTNQVMAVLTISTIPLILIYIVAQRYILDGLGGSGTGIK

SEQ ID NO: 8204 - protein, 312 aa, Bacillus licheniformis
MNKIPLKEARTAFPLKKIPASKIGWRDNVLAYTFLGPALLILSVFLVIPSIMAVYYAFTDYYLLTPDLRKFVGFDNFIKLFKDPIFLKSLSNTLKFVVLVIPLQIGAALGLALLLNKKRKANTFFKVAYFSPVVMSLVVISVLWLYLLNPNEGMINNVLTHVGLPPQPFLTSPNQAIFTIVFVSVWQGAGFQMLIFLAGLQNIPGDVYEAAQLDGMNKWQRFIYITLPLLKPTSVFIFITTLISAFKLLVQPMVMTQGGPVNSTMTVVYYIYQTGFTDRMVGYASSIALLFGTIIGLVTLAQRKLVKEDEGG

SEQ ID NO: 8205 - protein, 397 aa, Bacillus licheniformis
MWVHVSDDSEEGKVYQKRVDAFNKKYASENIEAKIDFIPRSGNGGGYEDKVNAALTTNTLPDVITLDGPNTAAYAKSGVIAPLDEYIKDQDDLLPSIKQQGTYQGKLYAIGVSESSVGIYYNKKMLKDAGVDLKTLPTVENPWTWDEFLELCKKLKNKYDKPAIDMQLQSKDEMLTYALLPFVWSAGGDVLSKDGKKAEGVFNDKLTVEAMTFIQTMLKEGYTTRTPVKQAFETEKYPMKMSGVWTVTDMETNFPNVDYGVMPYPVSPKTKKLVSPSGSWQFAMTQTSENKEWAAKLVDWMTNKESNLELSRSIAALPVRYSSEKVLAKEFSDEMNVFLQQLKETGHARPVTPAYPQVTRAFQQAIDDISFFDQHQDIQSVLDTRAKEMQSAIDKAN

SEQ ID NO: 8206 - protein, 324 aa, Bacillus licheniformis
MKPSIHDVAKKAGVSPTTVSRVLNNRGYISEKTKEKVYKAMEEINYFPNDLARSLFRKRTHLIGLIIPNSSNPFFGELAFHIESICAAMGYKLLLCNSLNRKDKEEKYLEMLMRNQVDGVIAVTYNRGILNYHRQNLPIVAIDHYLSETIPVIGSDNYDGGRKATELLIAKGCRHIIHINGPIELKTPANLRRKAYEDVMRQHGRQPITYEVPFHQNYREIISKLFDEQPAADGIFASDDLMAATVITEAKKRRKDIPGQLKVIGYDGTEAVQSILPELTTIQQPIELISKTAIEILSKAIEGEFDDLPLETYLPVQLLEGETT

SEQ ID NO: 8207 - protein, 176 aa, Bacillus licheniformis
MNVSHFFPETFVSLVKDMLTKTDGSTTKAIETLIGGKAEIEVFQQNNIDYDKLSPEEARLFQRDDDILFRTSSLKTGDDYLSYNYVYVKTNLLPPAIKQDLQEERLPIGKIIAELESRREIFSTGDCLGKHFTQLVPVSADRTYAFKKYQIISGRQCMFYVCELFDLEKICKLTAG

SEQ ID NO: 8208 - protein, 227 aa, Bacillus licheniformis
MNKKTVFKAFGMLMTGVLFFALYSAAALPSAHAANEKKPTVTSHTYKNIKALKYPQVSNVSPKSLQNKINKDFKHYIEQSYKDYVKNKKDGQQHGYQTDYQTSFEVKYRTGQKLSILTSNYVYSGGAHGNTAVRSFNYDLVSKKRVYLSDILNTKSKMDKTKTYIYNYIQKHSDIFFPDVKKKDIVLGKNTAFYYTNDGIAIVFQQYDVAPYAAGNPVVAVPKTVYQ

SEQ ID NO: 8209 - protein, 376 aa, Bacillus licheniformis
MTQSTDVLKQTPGRKIGPYRADQVGSLLRSEPVKKARLQKANGEISAEQLREVENEEIKRIVEKQKEIGLKAVTDGEFRRSWWHFDFLEGLDGVEGYTADKGIQFHNVETKPRGIKVTSKVDFTNHPMLEDYKFLHDIAGTHTPKMTIPSPNMLFFRGKLGESPYEDLDEFHHDVAQAYKKAIRAFYDAGCRYLQLDDTAWSVFFSDKGHEQIKAFGRQPDELRQSFANTINEAVEGRPDDLTVTMHICRGNFQSTWVAEGGYDAAAETIFDGLNLDGLFLEFDDERSGGFEPLRYVQRKDLQIVLGLITSKFGELENPDDIKRRIEEASRYADLNQLCLSPQCGFASTEEGNLLTEEQQWEKLRHVVEIAEDVWK

SEQ ID NO: 8210 - protein, 744 aa, Bacillus licheniformis
MIKKRKIDIFLVFILVLSAALNLYGIWNSDTDNAYYTAAVESMTQSFHNFFYASFDPAGFVTVDKPPVALWIQTLFALVFGVHGWSVVLPEAIAEVISVALLYFIVKPTFGKTAARISALIMACTPIAVAVSHTNNVDSILVLCLMIATWLLFKAVRKGKIGWLLGAFCMIGVGFNVKMLQAYMVLPAFLLFYMIGAKTTIRKKVVSLITAVIVLAGVSVSWAVVVDSQPEISRPYIGSSQTNSVLELAFGYNGIQRLTGQNGAGGGGTSSSDHDQKNQQQSGDIENNSDSANGQMAPPSGGEMPSGGPDGRQGDVQSGGGGPGGGTGGMFGTGTPGPLRLFQSELSGQASWLIPFVLFGIIGLLIAGLRRQRKFNETTTETIFWMMWLLPVAAFFSIAGFFHHYYLIMLAAPIAALSGAGWTALVRLYQEESGWKKRLLPIGILLTTAFELYILSPYLSEIGFIWSILIGAFGIVTSCLLIFLKKGKSFSYYVSLAALLGMLIGPFYWTTATLADGVNGMIPQAGPKSAQSFAGGGGGGKMQNNDGSGPPGFGSQDGQTDSNQNNNNGPGFGPGSNSQNSNDSSADTGSGQNSQNQNDEGASGRQQGRPSGGGSPGSGESVDEELLSYLEKNNTGEKYLFAVSSATSAQSYIIKTGKAVMAMGGFSGSDPILTVEKLEKLVKNGEVKYFMIGDGRGRDNSEITNWIKENGTEISKSEYSSSSSDDSQSGGPGGNQTLYKVELD

SEQ ID NO: 8211 - protein, 332 aa, Bacillus licheniformis
MKGKVMNMQKQVTFSIVVPVYNEAEVLQSTYDRLKTVMDSTGDPYELIFVNDGSSDDSIHTLKSLAQSDQAVKCINFSRNFGHQIAITAGTDYAAGEAIVVIDADLQDPPELILEMAEKWRQGFDVVYAVRTKREGETFFKKQTAAMFYRILRKLTDVDIPVDTGDFRLMDRKVVNEMNKLKEKNPFVRGLVSWLGFKQTAVYYERHERLAGETKYPLKKMLKLSLDGITSFSFQPLKLASYSGIVLSAIGFIYAFIVVCMKLFTTSTITGWSSMIILQCLFSGFILIILGAIGEYIGRIYDEVKDRPLYIIDGKYGFEEQRRARAPQRHIM

SEQ ID NO: 8212 - protein, 331 aa, Bacillus licheniformis
MSVLVVGGAGYIGSHAVYTLIEKKERVVVVDSLATGHAEAVHSEAAFYKGDIRDRHFLKQVFENEDIEAVMHFAASPISSKSKNVFTSFNENITGMETLLDVMKEYDVGRIVFASSAAVYGSPEDLPVTEETEPEPVHAHGKVKWMMEKMLMEAEKAYGLKYVILRSFNACGAHPSAIIGEDRGSETHLISNVLRTALGHLPFVHIDQSEDGTGVRDYVHVQDLAEAHVLAINHLRKGKDSRIYNLSYGESYSAEQIILAAQYVTGIPLIAAKLTETDIDSQATFAASSSRARKELGWTPQHNSLIAIIRDAWNWHSANPNGYASEKVKQG

SEQ ID NO: 8213 - protein, 379 aa, Bacillus licheniformis
MKKKGFISIFFLIVFLLLATTGCGKDDVQEAIYKKGLPKEDSPAFREFMRHELDLATDATLSYQNSTYTIMRSDKKGLRYYQYTDQEVDDFYSPFLSANKYPATKLYDLKTTEFLTKEKLIHNKLEYNLPEMTLDKKNVLKVKTKSGEKKIEFPSAKDKKVHLALAAVSKDSMLIQVDVYEKFKNGDLGDRQIYYLFLKSDLSKYRIVKEEELNSTIESGKLKEYLSVFPNVAKDGAYRKLFDKYIFDEKKNKVRKIKNTDILSKDGKYVYINGAKEKETNVMPDGIQQIQTMDNYLKGNEKYEAQFKIDFKQIAKEMDLNAGDARIANIHYFNKDYVVLYISYHGKTIGTAGSVNVLIDLQKNKQQPTAYLVDLGIES

SEQ ID NO: 8214 - protein, 476 aa, Bacillus licheniformis
MAYHNREKEITNILKNHERKANQLLRLAQSSRLLDTFNKIWVSIENKELPNFVSKNVMDFNVADIKSEINDWIKDLKECQENARRKFESMEDPTPEDLRKRNNISSDAVLLISQYENLKNGIDQVEQDFSNVARTHRAPMREALTDLSILYNSVNHVKGDFSDYKNVSVYVHGIEDSGNGFYKSVKDAAKKGDLIVRITTNEKNEYVYEYYYIDKYGKMYIKETYEEIKGLEYFDTNGRLHIVYDTNEPNEHRQATSDDLAEKLNEMGLMNEETKIDMFGHSYGGRRSLQFAMDYPDHVRSITTIGTPYDKNLLAAGANRARWLADNAAGRDTMNTSDYLDFNEENKNNDNGKDYSNAYTDMDCEAMTEDINHLKSANPEVYQKLQKMDITAAAGYRTEDTVSFSPYYTASGKHKINSDDIVSVESQHGDILGDLIDKKPEIEVRGSGVTNPGHIYEIEDSEFVDLIREVNKKEAE

SEQ ID NO: 8215 - protein, 212 aa, Bacillus licheniformis
MGHFRFNKELSHKAAGTISQLENAFIHVFENMVFFREELDRHSGKAAAALQKKMSDNINFFSKASSCLLYFADSVRCFAKAVELTDESDKPANVQPQSRSERNHTFSAERVQSEIKVNGESLHQATGKFESNLSTLDEVLHHFDTMLREMMYETEFPWEKFDDVWSDAKSHINSIMTELKKRVKELSANAKNIVKELKRVDNIISQQLQRVK

SEQ ID NO: 8216 - protein, 98 aa, Bacillus licheniformis
MLLKKNYLPVGSVVGLYNDSRRLLVIGRQMFSETNHVIRDYAAVDYPNGFTDPKEQLVLFNKQDIEVVYHYGYVDQKELQLDELLTEAEAGKKENKEQ

SEQ ID NO: 8217 - protein, 34 aa, Bacillus licheniformis
MNRFDHVKSVLRKQYIYFSFALIFHAFFIGTHEK

SEQ ID NO: 8218 - protein, 397 aa, Bacillus licheniformis
MYFLINILGIFIVMSVIYFCSPRKKSVKWRPILSLFIVELLVTWFMLGTKIGGWAINLIASFFSWLIACASDGIAFAFPSVMGNETVDFFFSALLPIIFVVTFFDILAYFGILTWMIDKIGWVISKVSRLPKLESFFSIQMMFLGNTEALAVIRGQLAVLKDNRLLTFGIMSMSSISGSILGSYLTMVPATYVFTAIPLNCLNALILASILNPVEVTKDEDIIYVPPKEEKKDFFSTISNSMMVGMNMVIVILAMVIGYVALTSCLNGILGLIVDGLTIQKIFSYIFSPFAFLLGLAPGDAMYVAQLMGMKLATNEFVAMMDLKTQLDAISPHTAAVATTFLTSFANFSTIGMIYGTYNSLFNGEKSAIIGRNVWKLLVSGIAVSLLSAGIVGLFVW

SEQ ID NO: 8219 - protein, 486 aa, Bacillus licheniformis
MSDRAIPRSYRMMEGFGVHTFRFVNEEGKAHFVKFHWKPVLGVHSLVWDEAQTIAGKDPDYHRRDLWEAIERGDEVEYELGVQMIDEEDEFKFDFDILDPTKLWPEEIVPVKIIGKMTLNRNQDNVFAETEQAAFHPGHVVPGIDFTNDPLLQGRLFSYTDTQLIRLGGPNFHEIPINRPVCPFHNNQYDGYHRMTINKGPVAYHKNSLQNNDPAPASEEEGGYVHYEEKVEGKKIRQRSESFNDHYSQAKLFWNSMSPVEKEHIISAFRFEVGKVKSKDVRRQVVHMFNRVDGELAKQIAAGVGVEPPEKDEGSNVTFKSPALSQENTVKLPQTRTVAILAEQGFDDEDLSRVLKEFKKAGIIPDIVSSALGVIEGAGGTEIEVGNTLQTVDSVLYDAVYIPGGQESIERLKLHKAASDFVNEAFGHYKAVGAAGEGVDLLLSAAGAHAASQPGIITSRGDKNKDDFGKKLVEAISGHRHWDRQV

SEQ ID NO: 8220 - protein, 205 aa, Bacillus licheniformis
MNNNDGRRKVNGHSKDQQLEQYRSDNRGKKMTTNQGLRVSEDEHSLKAGVRGPTLMEDFHFREKMTHFDHERIPERVVHARGFGAHGYFQVYEPMTEYTKAKFLQDPSVKTPVFVRFSTVAGSRGSGDTVRDVRGFATKFYTEEGNYDLVGNNIPVFFIQDAIKFPDLVHAFKPEPNNEMPQASTAHDTFWDFVANNEETAHMIM

SEQ ID NO: 8221 - protein, 149 aa, Bacillus licheniformis
MKFKIETLPNYRIAYMRRVGPYGPANIEVMERLKKWAKKKDLLESAILFAIPQDNPKTTPPDHCRFDACIVIPHDYQVDDTVFEGEISGGQYLIYEVEHTAEAIQKAYSDIFSSLQNKYQLDNRPIMEKYVGDMVNSPYCEICVPLKSV

SEQ ID NO: 8222 - protein, 472 aa, Bacillus licheniformis
MKYKTLAQFPKDFLWGASTSAYQVEGAWDEDGKGPSVIDARESYPEGTTDFKVASDHYQRYKEDIALFAEMGFKAYRFSIAWTRIIPDGDGDINPKGIEFYSRLIDELLKYGIEPIVTMYHFDLPNALQKKGGWSDRATIDAFEKYAKVLFESYGDRVKYWLTINEQNMMILHGSALGTLDPNLENPKKELYQQNHHMLVAQAKAIKLCHEMLPEAKIGPAPNIALIYPASSKPEDVLAAFNYNAIRNWLYLDMAVFGRYNTTAWAYMKEKGCTPVIAEGDMDILRSAKPDFIAFNYYTSQTAEASRGDGSDTAARGGDQHLQTGEEGVYRGSSNPHLKKNAFGWEIDPVGFRSTLREIYDRYQLPLIVTENGLGAFDQLEDGDVVNDDYRIDYLKEHIKQIQLAITDGVDVFGYSPWSAIDLISTHQGCSKRYGFIYVNRDEFDLKDLRRIRKKSFYWYKNLIATNGETLD

SEQ ID NO: 8223 - protein, 619 aa, Bacillus licheniformis
MNVQSMAKEILARVGGEKNVVSLVHCATRLRFKLKDRSKADREALENTDGVVTVVESGGQFQVVIGNNVPEVYKEIGRISQLLESSAADHSQKEKGSLAGRLVDVVSSIFTPLLGVMAGAGILKGLLLICTNAGWLSPEETTYTILYAAADSLFYFLPLLLAVTAAKKFGANPFIALTIAGALIYPTILELKNSGAHTEFFGIPVVLMNYTSTVIPIILAVFVMSYLERLCMRFIHESVKNFITPLLCLTVMVPLTLIVFGPLGVYTGNGIAAAILSVFDFSPILAGAIIAALWQILVIFGIHWGIVPVILNNIAVHGKDYIKPATAAAVFAQTGAAFGVMLKTKNKKLKALAGSAAVTGIFGITEPAVYGVTLRLKKPFVCGVISAAAGGAIIGYSGSVALASGAPGLLTIPIFYGPGFLGFIIGISVSFVLSILLTYIVGFDDPVEVTKEEPVEKSAGEPIYSPLQGEVLPLTEVSDKVFASGALGEGIAVVPSKGVVTAPADGIVTTAFPTGHAYGITTESGAEILIHIGMDTVRLEGKHFNPKAVQGQNVKRGDILAEFDLDALKEEGFDVKTPIIVTNSGQYTDVIPTDQKKVKTEERIITLISSPREENNHEI

SEQ ID NO: 8224 - protein, 277 aa, Bacillus licheniformis
MKIAKVINNNVISVLNEQGQELVVMGRGIAFQKKPGEAVDESRIEKIFRLDNKDVSERFKTLLDEIPIEFMEMSEEIISYAKLKLGKKLNDSIYVSLTDHIHFAVERHKKGLDIKNALLWETKRLYKDEFAIGKEALAIIEKKTGTALPEDEAAFIALHIVNAELNEEMPNIVNITKVMQEILSIVKYHFHIEFDEESLHYYRFITHLKFFAQRLFSGTYMESRDDFLFETVKNKYRDAYVCTNKIRQYIEKEYGHQLTNEELLYLTIHIERVVHQK

SEQ ID NO: 8225 - protein, 244 aa, Bacillus licheniformis
MKSNGSLLSALNPSAKLFSHLLVMCILMFVSNPKPTFFIWLFAVVIGIFFGGWTLSYLSKRLLPYLIFFILVFWMMAAFGKGEETIWEWAWFRVTEESVGNGLTIALRMLGFVTYGLLFTSTTDLTQFIMSLIHQCRLSPKWAYGLLAGFRFVPLFQSELSQMKAAHKIRGYKQKNSWKAFIRYALPLFSQGIRKSERIAVAMEARGFTGTKDRTYYQTAGLSGKDFVYFAGLASVAAGILLTF

SEQ ID NO: 8226 - protein, 530 aa, Bacillus licheniformis
MRSFLGCSNLSVRFYHRPETVLDRVSLSIEQGEKVLILGPSGSGKSTLLSVLSGIIPEHIEAEVTGEVNRRKSAGVMFQDPDSQFCMLHVDEEIAFSLENRSVPPKDMDRIISELMELVGLKIDKKTPIETLSGGMKQRLALACLLALEPEVLFFDEPTAQLDPASRQDIFALLRDVSRKSGQTMVFVEHVLDGCIEWMDRVILFNEKGQIIADGKPEEIVKHFQPEMKAAGIWQPKLYPAVWEDVTTQDDHPLAVKLSSTLKMKEEEAKNRPSADRDILIRTEDAAIGYRKKIVADGINLEIPRGEWISVIGGNGSGKSTFLKSLIRLEAVKKGRIYLEGRELKKWSDRTLYEKAGFVFQNPELQFIRDTVFDEIAFGARQRSWPEEQVERKTAELLQEFGLDGHQKAHPFTLSLGQKRRLSVATMLLFDQDLLLLDEPTFGQDEKTAKELIKRLKERQERGTTIVMVTHDMDIVDEHSDRVIVFHQGKAAYQGTPYQLFSDQDLVRRFSLIPPLHYRFMHERKERVPV

SEQ ID NO: 8227 - protein, 199 aa, Bacillus licheniformis
MNWNMKEVVMTVILSVACGVIYLGWSTLWIPVSAIVGPVGANFMFGIWVIASPIVAYIIRKPGAALIAETAAAAVELLTGSHFGLSALLIGVFQGAGAEIAFAIFRYKRYNLFTLMLSGALAAVGSATYSLMANGFAYYTTQTLILTLIIQIISGIVLGGWLAKAVVEALAKTGVLNQYEIMKEHRKKDDADAFISRMQ

SEQ ID NO: 8228 - protein, 228 aa, Bacillus licheniformis
MSFSAELRREADPIFEAIFEHPFVLGLASGRLEKEQLIHYVKQDYEYLNAFIQIYGIAISKCQNRKDMEMFHEQISFVLDSEVHPHKNLCRAAGVEYETLQGYPLAPSAHHYVRHMLTAAHEGTLGEILAVLLPCPWTYWEIGKKLMKDVQPDPSHPFYDWICFYGNRTDSITTKFCARLDEWAETAGKAEKEKMKELFLQSCQLEYGFWEMAYTVEDWPVEMGAVRR

SEQ ID NO: 8229 - protein, 423 aa, Bacillus licheniformis
MLKEKQLAESWEHDERWKGITRPYEAADVIRLRGTLEIEYTIARRGAEKLWKLLHTEDFVPALGALTGNQAMQQVKAGLKAIYLSGWQVAADANMSGSMYPDQSLYPANSVPEVVKKINRTLQRADQIHHMEGKEDIDWFAPIVADAEAGFGGQLNVFELMKSMIEAGAAGVHFEDQLSSEKKCGHLGGKVLLPTQTAVRNLIAARLAADVMGVPTILIARTDANAADLITSDVDSYDAPFLTGERTAEGFFKTKPGLDQAIARGLAYAPYADLIWCETSEPNIEEARRFAQAIHEKFPGKLLAYNCSPSFNWKAKLDDNTILNFQKQLSEMGYKFQFVTLAGFHALNHGMFELARQYKHRGMAAYSDLQQAEFASEVHGYTATRHQREVGTSYFDEVAQVVTGGTSSTTALKGSTEAEQFQS

SEQ ID NO: 8230 - protein, 529 aa, Bacillus licheniformis
MKTEEKRIHITGSINPHYEEILTKEAMEFIGRLERHFGGRRRELLHLRTIRQAEIDQGKNPCFLAETKHIREADWTVAPLPRDLEDRRVEITGPVDRKMVINALNSGAKVFMADFEDANSPTWKNCIEGQVNLRDAVRGTISFTNEQGKRYELKENPAVIMVRPRGWHLEEKHVLIGGRPVSASLFDFGLYFFHNAKELIKKGSGPYFYLPKIENHLEARLWNDVFVYAQNDLRIPQGTIKATVLVETILAAFEMDEILYELKEHSAGLNCGRWDYIFSFIKKFRNRDEVILPDRSAVTMTVPNMRAYSLLAIQTCHKRNVHAIGGMAAQIPAKDKPEINEAAFAKIREDKEREVKDGHDGTWIAHPGMIQTALDVFNQHMPSANQIHRKRKDVKVEEKDLLEVPKGRITEAGVRTNISAGIRYLASWLSGRGAAPIDHLMEDAATAEISRAQLWQWIRHPKGVLDDGRKVTAEMVKMMKEKEMQKIIDEAGVEHFRSGRFEEAGQLFEQLILDDEFAEFLTIPAYENI

SEQ ID NO: 8231 - protein, 45 aa, Bacillus licheniformis
MSLKSPMEFFRTLPKKTCPECGEKMEEQAESYFMECERCLAKKGE

SEQ ID NO: 8232 - protein, 692 aa, Bacillus licheniformis
MKIKNKQLDVILVLILLAALILNTYNIWLDDAANQYYLAAVKSMTQSFHNFFFASFDSSGFVSVDKPPVVLWIQTIFAKIFGVHTWSVILPQALAGAGSIYLLYALIKPKFGKGAARISALVMALTPIAVAVSRTNNIDSMLVFTLLLGTWCLMKAVKQGRLIWLLAAFGLIGLGFNMKMFQAFMVLPAFLLFYLIAAHANWKKKIVSAVLSLIVLTGISLSWALAVDYTSADSRPYVGSSQTNSVLELAFGYNGTERLLGQTTGNARGDMNGFGGDMQQPNGNAQAQNGNRSSGGSNGQNGAMQPPGAGGSADGSSQGANGGSQQPAGGGPGGGNGGPGGNGGPGGGQGGGQSMNMFGTGDAGPLRLFQSALSGQISWMLPFALLGLLGTIITWFRGRREKAGEMKETIFWSAWLVPVAGFFSIAGFFHHYYLIMMAPPIAALSGIGWYAMYGLYNNHKDWASYLLPAAVLTTAAFQVYILSAYTNQIGSAWMYVMGILGLGVTIALLMLKRRHPFGKQLTIISLCVLLLTPVYWSATPILYGGNSVLPESGPQLQSSNGGGMFSSDVDTGLLTYLRENNTGEEYLFATLTTVTAATYIINADENVMALGGFNGTDPILSVSELKNLIKKGRVKYFLISENSGNSELVSWIKENGTEISSDQYSSTDSFAQQGARGGPGGGQRQTLYKVEL

SEQ ID NO: 8233 - protein, 646 aa, Bacillus licheniformis
MSINQLIIRNLKKNIRNYYLYVFALIFSAALYFAFVTLQYDPAINEVKASIKGAAALKAASILLVAVVAVFVLYANTIFIKRRSKEIGLFQLIGMRKQKIFRILSLENVMLYFGSLVIGVFAGFSISKLVLMILFKIVDVQAEAKLNFSVEALVQTVIVFCGIYLLVMVMNYAFIKKQSILSLFKVTSATEDKVKRISVFQMIIGLLGILFILSGYYVSTELFSGKFKTVDELFYAMSFILGTVIIGTYLFYKGSVSFVSNIIRKSKGGYLNIYEVLSLSSIMFRMKSNALLLTIITTVSALAIGLLSLSYISYYSAEKTAEQNVAADFAMTNQKDAKRFEQLLDENNISYSKKEIHVIQAVFNLEQIVDGDPENMAGDPGKLPLAVVSDAEIAGMDVPKGDVIFSGYTDLLQKFMALKETGAVKVKSRHETIPLNYLGLKKESLLSFNFTSGGLPVAVVDDALFKRLSQDKDPKLQQKPSLFYGINLKHEDQLQQANELFATVNQNDQHLSLLDASTAQKSLFGLAMFIVGFLGLTFLITSGCILYFKQMDESEDEKPNYTILRKLGFTRNDLLKGIRIKQIYNFGIPLVIGLSHSYFAVQSGWFLFGAELWTPMIIVMVLYTVLYSIFGLLSVLYGKKVIKSAL

SEQ ID NO: 8234 - protein, 253 aa, Bacillus licheniformis
MMILEAKKIRKSYGNKHNKHEVLKGIDLQIQKGEFVSIMGPSGSGKTTLLNVLSSIDQVSGGTININQAEMTNMKEKQLAEFRKQHLGFIFQEYNLLDTLTVKENILLPLSITKISKKEAGQKFEEVAKELGIFELKDKYPNEISGGQKQRTSAARAFIHEPSIIFADEPTGALDSKSASDLLNKLSQLNQKRRATIVMVTHDPVAASFCSRVVFIKDGQIYTQLNKGGQDRQMFFQDIMKTQGVLGGVQHEH

SEQ ID NO: 8235 - protein, 336 aa, Bacillus licheniformis
MRMLKAFLTERRSWIAIFVLQQILFLFIAYVDASIPFTSILYMTYLSSFIFIVFVIVRFRKETKFYKSLEEWDHNLDVTNIREAETPFETMIEKSIAEQTKQLKQEAAQHRLALENEKDELMAWIHEVKTPLTAMHLIMETIEDQSLKARLAYEWLRIHLLLDRQLHQKRMSFIENDLSLEVLELKPMIFKEIKDLQSWCIPKGIGFDIQLEAGEVLSDAKWLSFIIRQLLTNAVKYSEASDVLIKSYEQDGKVHLAVQDFGRGIDPKDMPRVFDKGFTSTTEHHDQAATGMGLYLAKKAAKPLLIHIEVDSKPGTGTTFTLIFPMRNEFSRVLGV

SEQ ID NO: 8236 - protein, 228 aa, Bacillus licheniformis
MFKLLLIEDDESLFQEIKERLTGWSYEVYGINDFSEVMQEFAAIKPDCVIIDIQLPKYDGFHWCRQIRSRSNVPILFLSSRDHPADMVMSMQFGADDYIQKPFHFDVLIAKIQAIFRRVYDYNTEPEILKKTWCGATVDPEQNRVSNKAGAIELTRNEMFILKQLIDQKNKIVSREELMRSLWNDERFVSDNTLTVNVNRLRKKLDALNLGQYIETKVGQGYMAKEEG

SEQ ID NO: 8237 - protein, 469 aa, Bacillus licheniformis
MTEQTKKFPEGFLWGGAVAANQVEGAYNVGGKGLSTADVSPNGVMYPFDESMESLNLYHEGIDFYHRYKEDIALFAEMGFKAFRTSIAWTRIFPNGDETEPNEEGLEFYDRLFDELLKYNIEPVVTISHYEMPLGLIKKYGGWKNRKVIDCYEHYAKTVFTRYKEKVKYWMTFNEINMVLHAPFTGGGLVFEEGENKLNAMYQAAHHLFVASALAVKAGHDIIPDAKIGCMIAATTTYPMTPKPEDVLAAMENERRTLFFSDVQARGAYPGYMKRFFKENGITIEMAEGDEDILKENTVDYIGFSYYMSMVASTSPEDLAKTEGNLLGGVKNPYLESSEWGWQIDPKGIRITLNTLYDRYQKPLFIVENGLGAVDVVEEDGSIQDDYRINYLRDHLKEVREAIADGVDLIGYTSWGPIDLVSASTAEMKKRYGYIYVDRDNEGKGTLSRTRKKSFYWYKKVIETNGESL

SEQ ID NO: 8238 - protein, 614 aa, Bacillus licheniformis
MDYNKVSKDILQLVGGEENVQSVIHCMTRLRFNLYDNAKADRAKLESLPAVMGTNISGQQFQIIIGNDVPKVYKAIIANSGLSDEKAGEQQAGKKKNVLSAIFDVISGVFTPILPAIAGAGMIKGIIAIAVTFGWMSETSQVHTILSAIGDGAFYFLPILLAVSAARKFGSNPYVAAAIGAAILHPDLTALLGSGKSISFVGLPVTAATYSSTVIPILLAIWIASYVEKWIDKVTPTSLKMIFVPTLTLLVVVPVTLITVGPLGAIAGNYLSIGVNGLFENAGLITMILLAGTFSLIVMTGMHYAFIPVMFNNITQNGYDYLIPAMFLANMGQAGASFAVFLRSRNKKFKSLSLTTSITALMGITEPAMYGVNMRLKKPFVSALLGAAVGGAFYGITGVAAYIIGGNVGLPGITTFIGPTFIQAMIGIVIAFFAATAFAFVLGFEDIPSDEAAEQGAAPSEAGAGEIIQSPLKGEVKALSEVDDATFSGEVMGKGVAIEPEEGKVVSPVSGTITTVFQTKHALGITSDNGAEIIIHIGIDTVKLNGEHFTVHVNKGDAVKPGDELVSFDMDAIKDAGYQLITPVIITNTDRYQSIKPLKSDESVDIEEALIALA

SEQ ID NO: 8239 - protein, 180 aa, Bacillus licheniformis
MQNKAADRLILLGISLHSIYWLFILFLFFHFKHQLDAYAVWNPNVTDGYMEAGTFVAALKLMLYSGTLFNLGLLFILGLLIVILAQSIIFIALEIAAYVKIKKDPFSPWGSFILAMGIKNIFTNLSGIPFMAAGFILHKQQEPKEAVVEPAARRKARRNPALLMKKAAKARKRRNEGIKS

SEQ ID NO: 8240 - protein, 329 aa, Bacillus licheniformis
MCTSITLTTAGREHLLARTMDFDFELNGEVLLHPRRYKWKSEADGSEHAGRYAFIGMGRRLKNALFADGVNEKGLSCAALYFPGYAVYENEAKEQSRNLAPHEFVTWVLSECGDLEDVKKAAVSLNIVEREVSLLSTVTPLHWLLTDRSGASVVVEPTADGIQIHDNPVGVLTNSPDFPWHLTNLRNFIGLQPGQFAAKKMGGLTLSAFGQGSGLSGLPGDFTPPSRFVRAAFLKEHMKPVSDETEGVSAAFHVLSNMNIPKGVVMTDQGEDDYTQYTAVMCSETCSYYFHHYQNRQIQKVCLLQEDLDSNELKAFQPKQEETVHSLQS

SEQ ID NO: 8241 - protein, 281 aa, Bacillus licheniformis
MSLILLIILLIIIACIVKFGSNFVLDKFIFPSIKYMSKESFKKFRKFVEQKNTLLIYKKTLRASEYFFILLMIIFIAVSLFCVLSPSNSLLNFLFFGLLAFFLFCTIFIGDFNLNIKKELEKNQKEYESLIENTISKVNRNSYIFDRLKVFFGKTGMSLYFHCLFLILILTFLTEVNSIPYSIFYLFLLTLPLTLASWIYFSTFNTEEQNIRRIIGYLLLLIITISKSFSDFKIVIGLEVADSANDYIMFLILTVFTAIDRLLKSIVDDYTKFKEKRKIVE

SEQ ID NO: 8242 - protein, 322 aa, Bacillus licheniformis
MPGVKLNINKKSVGMTLGGKNGRITYNTSGKVTTSAKIPGTGLSYSSSKSISSSQKQSHLNNNNYSNNLELNAYLNHLTSFHTRLTSRQINWEEIKKESPPEINVAQLKSDLNNYKPNFFERILRLDKTKIEKLNKEITDAETKYKKEYDEWVKQQKFVKIIDDKNSVAYSEILEDIIKIEDTIGKIKEIISNENSEVLLNLLVDTSILPNQEEYISSAGNLLTKKLTKTKYYQNQLNFIASLSIGLAKVIFQIIPVETVSINVLEKRIDTVDGHEKTMTIFGVKFKKEQFMALNINYIKPIDTLQLFETSLDFKKTKGLQL

SEQ ID NO: 8243 - protein, 473 aa, Bacillus licheniformis
MRKCFIQVLALLFIIAACFAPNQASAQTQKPVFSEVTVHDPSIIKANGTYYVFGSHLASAKSTDLMNWTQISSSVHDGNPLIPNVYEELKETFEWAESDTLWAPDVTQLEDGKFYMYYNACRGDSPRSALGLAVADDIEGPYKNKGIFLKSGMDGISNDGTPYDATKHPNVVDPHTFFDQNGKLWMVYGSYSGGIFILEMDKKTGFPLPGQGYGKKLIGGNHSRIEGAYILYHPETQYYYLYMSFGGLAADGGYNIRVARSKNPDGPYYDAEGHAMIDVRGKEGTLFDDRSIEPYGVKLMGNFSFNNKNGYVSPGHNSAFYDEKSGKSYLIFHTRFPGRGEEHEVRVHQLLMNKQGWPVVAPHRYAGEKLEKVKKSDVIGDYELVRHGKDISADIKESKEIRLNQNGKITGAVAGTWKNTGHNKIELKIDGKTYDGVFLRQWDAASERKVMTFSALSREGDAVWGSSLKRAEF

SEQ ID NO: 8244 - protein, 481 aa, Bacillus licheniformis
MSKASFRDYALSGDITKALDHLGYKEPTAVQSEVIPAVLKKRDVVVKSRTGSGKTAAFGIPLCELTEWEENKPQALVLTPTRELAAQVKEDLTNIGRYKRIKAAAVYGKSSFERQKTELKQKCHIVVGPPGRVLDHIEKGTLPLEKLKYLVIDEADEMLNMGFIDQVGAIIRHLPEERLTMLFSATFPEDVEHLSLQYMKDPLKIEIKAGGTTTADIEHQLIIVNENDPFSLLVDLFIVENPDSCIVFCRTQEQVNELQWRLSVLGYPCEKIHGGMPQEDRFAVMNRFRRGAFRYLIATDVAARGIDIENITHVINYELPLDQESYVHRTGRTGRAGSRGKAITLASAREKRMIADIEDYIGFHIPIIEEPSKEEIARAKAAFQKKINRKPELKQDKSESLNKEIMRLYFNGGKKKKLRAVDFVGTIAKIDGVSAEDIGIITIQEQGSFVEILNGKGPLVLDAMKNTTVKGKLLKVHKARK

SEQ ID NO: 8245 - protein, 200 aa, Bacillus licheniformis
MFSFKKSRFFWLRSNVILILLTALLLLNKPYWEKNANVMFFMFVCIAELFIILLALVYGFQTKKTIARPPSRAIRKTNIPIGIFVFSIFSLFFGFAMSGDIPYPNSALIIYLTINMVFAFVSLFVPTLIIKLYEVNVYDESNGLITDFFRYVAILVSSLNYEVQIVLARLPFVLQRLLGVIFIAVLLWELTMIGLIFENN

SEQ ID NO: 8246 - protein, 259 aa, Bacillus licheniformis
MLDSKIILTTNELVAAFLLCRYEKAAEDIINDQQLIQDEKDIEPFSIQAENLLKQRGYWADGTESNLQKGLENLIHLLIQSKRKVRCIHRKRVLIVHHVQKDELIVQEIENQNHSFSILRSRESFLEMLKTFYHSYTDKKPEHEIFEMDEDSFDEFHEVEADVIKRMAEDPKTHPTISQFSFDFLANNQELDNISFVESDYIQNQTRLDQVAFLLRSDNFIWHLDYENIKKTGSLYLLPVAVDEYFGKIVDTMNEFYDL

SEQ ID NO: 8247 - protein, 530 aa, Bacillus licheniformis
MKVLDVSEVIDAIDQLIKEKKQEEKEINAIRESVQKIAELDDALKGEGGNAIKEHFSVLHLPVLLYFQHFIDQYIQNLKDIKAKIRTYESTEGFVKEEFLTHDVKKGLTELKRQTNDTVDSINDEVDKISHLIGGGSISLASFNEHISEAKKHVNNTVSDLKELDRDANSILKQSSNSIAQLSKLTEKVNTWSKGGAILSKKTIKEVENYFSETDVVKQMIDEAVDLAEKQDDPTMMGRIAEWLDLIGTGNGALAVTKGVIAVNVLATKMLELEKDGKGNFRVKASPKWTQGANGKYDSKVAQFVYNILKKGDPNSSKPIKKWLGKFQNKPSGLLRKIVGLGPNTTRISYKKILESQSFLKHKPEELKSYKTKVDVKGTVGKFKDEASITKLAKKIPYAGTIFSLTTNGAEFFSDDNKDKSWFEKFGRFSAGIGMDAGVGALTASGAGLGSLVCPGPGTLIGGAIGAGIGITGSIIAGDQVKEWGEDAAGWIEDKGKEAGEWLSQKASETTDTISDGLSGAKEFVTSWFR

SEQ ID NO: 8248 - protein, 89 aa, Bacillus licheniformis
MAEIKVKAEEVKTVFSSLQTKISALSISGSKADISNSSMDVVNKIKKIEKEYEQLLKKYKEALSSVEKDAWSNIKVLIDTDKNISQKMK

SEQ ID NO: 8249 - protein, 130 aa, Bacillus licheniformis
MSNHAAKISSLEKDISSLSHNIKDTQSKIAELKKAKTAITGELHTLSNNATLINQPDITSHIWNGRHTKQFINIRSNIAHSYQNIQRETDGLISHIEQEIENLEMQISNMEMFLSIQKQQLTDIKKQVNH

SEQ ID NO: 8250 - protein, 433 aa, Bacillus licheniformis
MRMVDIITKKQNGEELTTEEIQFFIKGYTDGSIPDYQASALAMAIYFQDMTDRERADLTMAMVNSGETIDLSAIEGIKVDKHSTGGVGDTTTLVLAPLVAALDVPVAKMSGRGLGHTGGTIDKLEAIKGFHVELSKDEFIELVNRDKVAVIGQSGNLTPADKKLYALRDVTGTVNSIPLIASSIMSKKIAAGADAIVLDVKTGAGAFMKTDEDAVNLAKAMVRIGNNVGRQTMAVISDMSQPLGFAIGNALEVKEAIDTLKGEGPEDLTELVLTLGSQMVVLAKKAETLDEAREKLIDVMKNGKALQKFKDFLQNQGGDSSVADNPEKLPQAAYKIDVPAKEAGVVSEIVADQIGVAAMLLGAGRATKEDKIDLAVGIMLRKKVGDAVEKGEPLVTLYANRENVDDVIAKVYDNIQIAETAEAPKLVHTVITE

SEQ ID NO: 8251 - protein, 393 aa, Bacillus licheniformis
MKYLIGLIGLFVVLGLAWLVSSGKKRVKYRPVIVMIVLQFALGYILLNTGVGNYLVGGFAKGFGYLLEYAAEGVNFVFGGLVNVNESTFFISVLLPIVFISALIGILQYWRILPFIIKYIGLALSKINGMGKLESYNAVASAILGQSEVFISLKKQLGLLPKHRLYTLCASAMSTVSMSIVGAYMTMLKPEYVVTALVLNLFGGFIIASIINPYEVDREHDMVEVQEEEKQSFFEMLGEYIMDGFKVAVVVAAMLIGFVAIIAMINGIFSAALGISFQELLGFIFAPFAFLMGIPWHEAVNAGSIMATKMVSNEFVAMQSLAQGSFHFSGRTEAIVSVFLVSFANFSSIGIIAGAVKGLNEKQGNVVARFGLKLLYGATLVSFLTATVVGLIY

SEQ ID NO: 8252 - protein, 223 aa, Bacillus licheniformis
MTIANLIDHTALKPHTQKSEIKKLIEEAKAYQFASVCVNPTWVEFAAEELKGTEIDVCTVIGFPLGANTTETKAFETKDAIAKGATEVDMVINIAALKDGNDDFVEADIRAVVEAAKGKALVKVIIETCLLTDEEKERACRLAVAAGADFVKTSTGFSTGGATAEDIALMRKTVGPDIGVKASGGIRTKEDVETMISNGATRIGASAGVSIVSGAEGKNEDNY

SEQ ID NO: 8253 - protein, 312 aa, Bacillus licheniformis
MDKEKQQLSIEAARLYYQSDYSQQQIAEQLQISRPTVSRLLQFAKEKGYVQIRVMDPFEDMDALGAMLEEKYGLLEAHVVFSPTADYTTITHYLSRFGAEYMHGAVKDGDIVGVSWGTTMYQIAQNMQPKQVKGAEVVQLKGGISHSSVNTYSSETIQLFAEAFQTMPRYLPLPVVFDNPEVKQMVEQDRHIKRIIEMGKQANIALFTVGTVRDEALLFRLGYFHEEEKALLKERGVGDICSRFFDAEGNICSDAIDSRTIGIELADLREKERSILVAGGSRKKAAIHGALKGKYANVLIIDQHTAKELLDD

SEQ ID NO: 8254 - protein, 144 aa, Bacillus licheniformis
MYIISKLERQNVKVTEIPKWGSYLRKTWENRFAASMELPERDAILVSHFLWHLFSYGMKPCFTGGQADQAFSEQPKRDCFLFYQHTDDAYILEHAEQLIAADLKGEEDAYITDKHMTWTYAVTHESAYGPYFAIQLDEKEHEPI

SEQ ID NO: 8255 - protein, 364 aa, Bacillus licheniformis
MKAPVRYIWIGMILCFLSVSLAVGCIKAEDQSDDEKNDEALQPAEHFVYRHLMSDQGLIKTGFSDQPVYLSESLGLWMEFLISKKDGEHFHEQYQHLNESFLMNNNLVSWQIQNGQASGVNALIDDLRIMVSLDQAAALWGNSEYKQTARNIGAALRKYNMNNGILTDFYDSASQSAAKDITLSYIMPDALSILKKNGVINKELESRNASILYLAPLKNGFLPKAYSTETKAYTYDHEVNLIDQLYAAWHLPPKDQKAAVLADWLKQTFQTGGKLYGRYSLDTKKPAVQYESPSVYALAILFFINQNEDKTVIKALYDRMNDFEILDSSETYYGGYMSGNDTHSFDNLLPLLAERKLLNENLIQ

SEQ ID NO: 8256 - protein, 283 aa, Bacillus licheniformis
MKISFNESHKMFAYMTGLAAALALFIHYISVQRFEPVLIICITLAIIAAGIWLGSIYALAGTIIVLFVLGTLMMFFHTGQGEAASSETGLQMLVIWGVALLLFSFMSGRIHDIAIGLHRSVKHLQDEIKSFVAIDRVTGFDNKQRMKLELSEEIKRAERYGNSFVFLLLHMHYFKEFKSLYGEKETDRLFQFVSSQIRSCVRETDKKFRPAEERFGILLTHTPAEHMPAVLEKLKKQLDTYQLKNGKYVTLTFHVCHLSYQNDLKTADQFLEELENEMMMNEL

SEQ ID NO: 8257 - protein, 576 aa, Bacillus licheniformis
MNCKRLLLLYAAVLILSAAFYVPDSAEAKQQEHGILIVYSTLDGKESADVKILDLIAGHFSSRVAVIKDADVKASDLATKDRVIYYGQTKRKLSKKLAQLISSSKKPVIAIGFNAGQFSQFAGLTLKSKDNVYQIRSTNEENDSSLESGVRVLDVSGLKGKALYTYKADEGKARPFGWKTGKGNVYIGLTDLLNNSLLAAKQLRQAFGETAGSTLLYLRLEDISPMSDEKLLLQAGSYLHKRNIPFILSVIPVYVNPETGDKVYMSDKPKLVKVLRKLQDMGGSVIVHGYTHTYRYSETGEGFEFWDAKADQPITSENAEEPATLLQKEQSFPNEEAYRNYLKPFRKNEETYTRQKLTNAIEDLTAEGLYPLAFEAPHYTVSEHGYQIASQYFTSLFGQVQLSDTTWKTSGAGPFVTNPAMLHGMTLYPETIGYVDQSEQNPLGKVEERISQMIDFEGGVAGAFYHPYLGMKYLPELVDQMERIPNSEWLDIKKTKQTVNTDKVEIHTSGDGTIQVKSKVSPIETFFDHHQQSPLEKALWILSLIVLLFVVMFVSYTLYLRATLKKRIFKERKSRG

SEQ ID NO: 8258 - protein, 499 aa, Bacillus licheniformis
MGNVLFLVSLSLIWVMLLYHMFLMQGGFRHYMTFERNIPKWKENVKDLPKVSVLIPAHNEEVVIRQTLKAMVNLYYPKDRLEIIVVNDNSSDRTGDIVDEFSTQYGFIKMVVTKPPHAGKGKSSALNCGFAESNGDVICVYDADNTPEKMAVYYLVLGLMNDQKAGAVVGKFRVINAAKTLLTKFINIETICFQWMAQGGRWKWFKIATIPGTNFAIRRSIIEQLGGWDDKALAEDTELTIRVYNLGYHIRFFPAAVTWEQEPETWKVWWRQRTRWARGNQYVVLKFLAQFFKLKRKRIIFDLFYFFFTYFLFFFGVIMSNAIFVINLFYNLHLSFGFLSIILWVLAFFLFMTKVMITLSIEKTEMNRQNFFIVFLMYFTYSQAWIVLVIYSLFVEIKHRLFKQHGTKQNDTIKRKAGDFFEIYHHMSGKLLADHGDGTSGCSQRRYSRRLDPGGKQPGTSQAASAHKRSLDFIRGKRQRRADVSNTGGRLLYPSAAYT

SEQ ID NO: 8259 - protein, 708 aa, Bacillus licheniformis
MKYIIICLASFLLITATGQAAAAKDVTVDGSILGENSREQAKQQVLTNDLLTLYGAKDSAELTYQIPAGASSTHQQLTLKYEASDLLISPSSLTAEIDGEPVKTVKLEGNNGKKTLKLSLNKSQSSPGFHSLSLKFYGVVHEGVCVRQDSSGNWIKIYPDSRLNIGEKNESKGAALEHYPYPFAQSGSSVEKTAIVIPDHPSSAEIEAAVKTEAYLKTVDNSISTKILGESDLAKIDRPTIVIGVHHHWSGKVKKLLKQAKLEAKEDKLLLAKRMLKAKDKQQPVLFAAAASDDVLSEKISVITDKTYAAQLSGDTLAIGKLQQHSKRGGSKLTLEDFGAGDLTIGSGQTSSEHFYYPAPALLDKNQPAKLSLAMKKSKTIQKQAGQSDLAAEQAELKVMINGQPHSVGLDDIGKEDKNGFYHVSLKVDPKLLQKSRYIDIQFAASGLKENNPCYAVNEDKWIFIDKQSALSYHVSDTSASADFQAWPLPYAGDHNNKTLMILPDNADQSKIDELSLVVGSFGSEARQAFTVKTSSEVKPDDVKGRNVIFIGSVDQFSLLKEKTAELAVPTAKNGTFDVSSFQMLNETTKQVAFTQTSLWDSNYSMAVFAPFKGQGTAVTKEMINFLNSNDFAATVVNETDSHQLFTNHQQLTAKSAETKTDDKQESNQQHVLYIAILIVIIAAAVILILTTARRRKRKANAGGGIDE

SEQ ID NO: 8260 - protein, 425 aa, Bacillus licheniformis
MKPPLSKIGEKMIEKTGVRAVMSDIQEVLAGGERSYINLSAGNPMILPGVSAMWKSALADLLDDDRFSSVIGQYGSSYGTDELIASVVRFFSERYSAGIRKENVLITAGSQQLFFLAINSFCGMGSGSVMKKALIPMLPDYSGYSGAALEREMIEGIPPLISKLDDHTFRYELDRKGFLERMRIGAVLLSRPNNPCGNILPKEDVAFISDACREANVPLFIDSAYAPPFPAIHFIDMEPIFNEQIIHCMSLSKAGLPGERIGIAIGPSRYIQAMEAFQSNAAIHSSRLGQYMAASVLNDGRLADVSLNEVRPYYRNKFMLLKETLLCKMPEDIKWYLHQGEGSLFGWLWFEDLPVTDAALYEYMKADGVIIVPGSSFFHRQSRRLAHSHQCIRISLTAADEDIIRGIDVLAKIAKGVYEKQVEYL

SEQ ID NO: 8261 - protein, 412 aa, Bacillus licheniformis
MTTLTGDIVNMVNEQIVPNIHELQTYQNDKGQITEHHERAEQLLLQLIEDAGAIYEAVHLTAAKEAFKEDVLDWISRGLGETPYFDRLLTAYRAPHDQETTFFAAPIVTPNGPHAKGCYFEAFLAVREEPAMMRPIEEDLPHPENGCQSLKLLAGTKGFTEEKCIVFFPENVKTKEKITSQTFAIFYFNKFYHIYHEDTLKRARAIFEHAPFKSAQLSHDRTYEARVLWGYLHDYFHHCGKKPFHLHIQAKMNFFAGILEEVKVDCQAILTLWERQYDGWEEIIEFVLYERLLRYPSQHNATRNFDSGTGYFLFSWMIENGRSIQKGEEKRVSLDLPRCMDDLRKLVAEIEQLEEIEDDTAYKEAAERYVRQYLPPGREGERFSVPEQYFIDEINKKIETARLRFERERLEA

SEQ ID NO: 8262 - protein, 188 aa, Bacillus licheniformis
MISTKVHKEQAVMIVHTLGPKGTNCEKAGLLWLKNKGVRGEVRLYETLEEALLHVKSTENSVLLGCAVYPFLHQIVFENLADLKIIDSFVMPTYNMVFAAKQHTMASDIQIVASHPAPAHLAKLFSSQVQFVTSNAQAALACASNAADGCITTIKAADEHRLKVIKDFGEVPMCFTIHGLKSIEGGSR

SEQ ID NO: 8263 - protein, 425 aa, Bacillus licheniformis
MTKRNKNLAIICQNKHLPFIFEEAERLGLKVTFFYNSAEDFPGNLPAVERCVPLPLFEDEEAAMDVVRQTFVEFPFDGVMTLFEPALPFTAKAAEALNLPGLPFTTMENCRNKNKTRSILQQNGLNTPVFHEFHTLADLENRKLSYPLVVKPVNGFSSQGVVRVDDRKELEEAVRKVEAVNQRDLNRFVHGKTGIVAEQFIDGPEFAIETLSIQGNVHVLSIGYKGNSKGPFFEEGVYIAPAQLKEETRLAIVKEVTGAVSALGIHQGPAHTELRLDKDGTPYVIEVGARIGGSGVSHYIVKESTGINFMQLVLQNALKPLESSEFEGEIRPVRTAGNYIIPVQGSGTFEKIDGLEEVKQRQEVKRVFQFMRRGAKILPYPHFSGYPGFILTSHHSYEECEAFYRELDDELHIIYQNNLTGTIGG

SEQ ID NO: 8264 - protein, 312 aa, Bacillus licheniformis
MLTNVLKYRVHILFIVLCLIGGTTWAFQKAGLSDSLPFWSAGMRFMIASILIAAFLLARRQFVLSKELLVLSFLNGIMYFSVPFGSVYWASLYLPSGLVSILAASISVFALMINRLVKGTPATKLQKWGICLALLGITIVFGNQLLIKVDVIEIVAMIVILCAMFGSAFIQIKVQQRIRSLPILSFNSLSMLSGGAVLLISSLIFESGTRTFSGVSLYALLYLAVVGSILGFWINIYLLKKWHISKATSHLFISPVIALYIGFLFLDEKLNANIYLGTLFVIFGVMFINLKKEERIAKIDETKQKLGHHLSK

SEQ ID NO: 8265 - protein, 292 aa, Bacillus licheniformis
MAFVSMKELLQEAKEHHYAIGQFNINGLQWTKAILEAAEEERSPVIAAASDRLIDYLGGFKTVSAMVAALIEEMSISVPVVLHLDHGKSPERCKQAIDAGFSSVMIDGSHSPIDENIAMTKEVVSYAGVRNVSVEAEVGTVGGMEDGLIGGVQYADIGECERIVKETGIDALAAALGSVHGKYQGEPNLGFKEMEEISRVTDIPLVLHGASGIPADQIARTIRLGHAKININTECMVAWTEKTRSIFKDNPDLYEPRAYMTPGISAVKETVKHKMREFGSSGKAVCTQKIEI

SEQ ID NO: 8266 - protein, 278 aa, Bacillus licheniformis
MKLCFNEATTLENSNLAKDLEYCEKHGYDYIEIRTMDKLPEYLKDHALSELAEYFQTHHIKPLALNALVFFNNRDEKGHREIIEEFKGMMETCKMLGVKYVVAVPLVTEQKILKEDIKASSVEVLTELSDIAEPYGVKIAVEFVGHPECTVNTFSQAYDIVMTVNRDNVGLVFDSFHFHAMGSSLEDLKKADGKKIFIYHIDDTEDFPIGFLRDEDRVWPGQGAIDLDAHLSTLKDIGFSDVVSVELFRPEYYKLSAEETIRTAKETTVEVVSKYFKI

SEQ ID NO: 8267 - protein, 288 aa, Bacillus licheniformis
MKLALDPSMYRDDLTLEETVYKTAELGYEYIELSPREDFCPFYKYPKVDSAKIKQLKRLLRDTGVKLSSLLPLYHWAGPDEDRRQAAVRNWKRAIEIAVELEVDLMNSEFSGSKYDPLTSEEKFIKSMDELLPIFEKEGIKLNLQAHPYDFIETHKGALDMIRALDKDWINLVYSTAHTFFYDDGKGDIETMFDEAGDRLTHVLFADTYNHKAAHGLRYIVNPPDAKVTVHQHLDIGQGEVDFDMIFRKLREMKFDGIATNAVFAWVDERADESSRFMLEKLKQELLG

SEQ ID NO: 8268 - protein, 344 aa, Bacillus licheniformis
MKLRIGVIGTGAIGKEHINRITNKLAGGEIVAVTDVNQEAAQQVVTDYSLNAKVYPDDDSLIAAENVDAVLVTSWGPAHESSVLKAIKANKFVFCEKPLATTAEGCMRIVNEEVKAGKRLVQVGFMRRYDSGYVQLKEAIDNRVIGEPLMIHCAHRNPVVGDNYTTDMAVVDTLVHEIDALHWLINDDYESVQVIYPKKSKNALPHLRDPQIVIIETKGGVVINAEIYVNCKYGYDIQCEIVGEDGIVKLPEPSSISLRKDGKFSTDILMDWQRRFVDAYDVEIQDFIDSIQQKGEVSGPTAWDGYIAAVTTDACVKAQESGQKEPVALQEKPEFYQTFTTVKK

SEQ ID NO: 8269 - protein, 434 aa, Bacillus licheniformis
MSNGSAAVSPFNKRTVAAALANYIDAGSIVAGSAGLSLWVSYLKLSDTQIGLLGAFSANAISAAIGALLGGFLADKIGRKAVYTNSMLVYALGICLVLFGTSFPFLLSGYIIIGLSVGADITASWTIIAENAPKKNRARHCGVAQVAWAAGAVVVLLLSVLLGDLGLLGNKIVFGHLLVIALITYVLRKRLPESDAWQDQSEMAQAVRKPKTPYLDLLQPKYLKSILFLMGVYLVWNLAAGVMGFFMPYIYQQVGDVSATMANILQMGLFIFTGLGVAFIFMPFADKYRKTVFGISAFAAVIGWSLFLLPAEGMPILILFIVMIGINNGAGQQANYQLWASEIFPTEYRASAQGLMFFLVRISIGAWSLFVPMIISNFGIAFMAAILLGCVTASMLIGLFFAPNTSGKSLEQIQEELYGTPPAQAGQVQTRKIM

SEQ ID NO: 8270 - protein, 300 aa, Bacillus licheniformis
MGKTQILWGIAPIGWRNDDIPEIGAGNTLQHLLSDIVVAGFQGTEVGGFFPEPAILNKELELRNLRIAGKWFSSYIIRDGIEEAAKEFAAHCQYLKDVHADVAVVSEQTYSVQGLDKNVFKEKPYFTDEEWQRLFEGLNHLGEIAGRYGLKLVYHHHLGTGVQTEEEVDRLMAGTDPALVHLLYDTGHAYISDGNYMNILEKHIDRIRHVHFKDARLKIMEKCKREGNSFQQAFLQGMFTVPGDGCIDFREVYQTLLKHGYSGWIVVEAEQDPDVANPLEYALIARKYIDRHLLNVPATN

SEQ ID NO: 8271 - protein, 637 aa, Bacillus licheniformis
MGKKIRLTTAQALIKFLNQQYIHVDGEETPFVEGIFTIFGHGNVVGIGQALEQDAGHLKVFQGKNEQGMAHAAMAYSKQMLRRKIYAVSTSVGPGAANLVAAAGTALANNIPVLLIPADTFATRQPDPVLQQVEQEYSAAITTNDALKPVSRYWDRITRPEQLMSSLIRAFEVMTDPAKAGPATICISQDVEGEAYDFDESFFEKRVHYVDRKEPSERELKGAAELIKSSKKPLILVGGGAKYSGARDELIAMSEAYNIPLVETQAGKSTVEADFANNLGGMGITGTLAANKAARGADLIIGIGTRYTDFATSSKTAFDFDNAKFLNINVSRMQAYKLDAFQVVADAKVTLGKLHGLLEGYKSEFGSTIKELKDEWLAERDRLSKVTFKRENFTPEIKDHFSQDILNEYADVLQTELPQTTALLAINETVDPDSVVICSAGSLPGDLQRLWHSNVPNTYHLEYGYSCMGYEVSGTLGLKLAHPDREVYSLVGDGSFLMLHSELITAIQYNKKINVLLFDNSGFGCINNLQMDHGNGSYYCEFRTADNQILNVDYAKVAEGYGAKTYKANTIEELKAALEDAKKQDVSTLIEMKVLPKTMTDGYDSWWHVGVAEVSEQESVQKAYKAKEKMLESAKQY

SEQ ID NO: 8272 - protein, 325 aa, Bacillus licheniformis
MKYTFNEEKEFDIVAIGRACIDLNAVEYNRPMEQTMTFSKYVGGSPANIAIGSSKLGLKTGFIGKIPDDQHGRFIETYMRNTGVDTSQMAVDKDGHKAGLAFTEILSPEECSILMYRDDVADLYLAPSEVNEDYIAKSKMLLVSGTALAKSPSREAVLKAVQLAKKHQVKVVFELDYRPYTWTSAEETAVYYTLVAEQSDIVIGTRDEFDVMENKSGGSNEESVQHLFAHSADLVVIKHGVEGSYAYSKSGDVFRAKAYKTKVLKTFGAGDSYASAFLYGLVSGKDIETALKYGSASASIVVSKHSSSEAMPTVAEIEELIAAQS

SEQ ID NO: 8273 - protein, 271 aa, Bacillus licheniformis
MSHLLRKPQANELSQGVKLVHEVKKSNSDLSYVEFKVLDLAPGSSYEESLSKQECCIVALTGKITATDHEQTFENIGTRESVFERKPTDSVYVSNDRKFGITAVTEARVALCYSPSENQLPTKLIKAEDNGIENRGKFSNKRTVHNILPDSDPSANSLLVVEVYTESGNWSSYPPHKHDQDNLPEESFLEETYYHELDPQQGFVFQRVYTDDRSIDETMTVENGNVVIVPAGYHPVGVPDGYTSYYLNVMAGPTRKWKFHNDPDHEWILER

SEQ ID NO: 8274 - protein, 487 aa, Bacillus licheniformis
MAEIRKLRNYINGEWVESKTDKYEDVVNPATKEVLCQVPISTREDIEYAAQTAAEAFKTWSKVAVPRRARILFNFQQLLTQHKEELAHLITIENGKNTKEALGEVGRGIENVEFAAGAPSLMMGDSLATIATDVEAANYRYPIGVVGGIAPFNFPMMVPCWMFPMAIALGNTFILKPSERTPLLTEKLVELFEKAGLPKGVFNVVYGAHDVVNGILEHPEIKAISFVGSKPVGEYVYKKGSENLKRVQSLTGAKNHTIVLNDANLEDTVTNIIGAAFGSAGERCMACAVVTVEEGIADEFMEKLVQKASEVKIGNGLDDGVFLGPVIREDNKKRTLGYIQKGIEEGARLVCDGRENVTDEGYFVGPTIFDNVTTDMTIWKDEIFAPVLSVIRVKNLKEAVEIANQSEFANGACLFTSNSNAIRYFRENIDAGMLGINLGVPAPMAFFPFSGWKSSFFGTLHANGKDSVDFYTRKKVVTARYPAPDFN

SEQ ID NO: 8275 - protein, 254 aa, Bacillus licheniformis
MKLMRIKEMEDYILTNGTVSLDELCQVFNVSKNTVRRDINKLTEKGVIKKVYGGVTAIEKTALIPFENRTIQNKDAKTKIARYASRFIEDHDLIFIDSGTTTRSILETLDPNKNVTVLTNSLDIINAAAAMQNINLIIIGSNYKRKTQSFVGMDDPGTLDKYNINKAFMSATGATLTHGLTNSDLLEYEIKKKISEKAKQVYLLADHSKFGKSTLLTYAPFDRLHAIVTSQALDEEYHVYCKDRKIEIHLAKHV

SEQ ID NO: 8276 - protein, 311 aa, Bacillus licheniformis
MKKVKVGKSDLHVFPIGLGTNAVGGHNLYPNLNEETGKELVREAIRNGVTFLDTAYIYGIGRSEELIGEVLKEFNREDVVIATKAAHKKEGDDFVFDNSPAFLKKSVEESLKRLQTDYIDLFYIHFPDENTPKDEAVQALHELKQEGKIRAIGVSNFSLEQLKEANKDGLVDVLQGEYNLLNREAETTFFPYTQEHNISFVPYFPLVSGLLAGKYSEDTTFPEGDLRREMENFQGERFKENIRKVNQLAPIAEKHNVDIAHIVLAWYLARPEIDVLIPGAKRADQLIDNLKTAEVNLSQEDIDFIDRLFAR

SEQ ID NO: 8277 - protein, 297 aa, Bacillus licheniformis
MKRLVRSIFLITAAIAAFGFGFSGHAEAASHSQPQLNPNKLLNVAHRGASGHAPEHTLLAYKLGQKMKGDYIEIDLQMTKDGHLVAMHDETLDRTTNGTGFVKDYTLKEIKELDAGSWFNEAYPERAKPEYAGLKVPTLEEIIQTFGRSARYYIETKSPEDYDHMEEKLLDILKQYKLTGADIHSSKVIIQSFSPESLKIIHNANPNIPLVQLLWYDKPAAITDAELKQYQSYSVGLGMNFDRIGRAYVQKIRRTGMLVHPYTVNKKEDMKRLLDWGATGMFTNFPDRLRDVLREKK

SEQ ID NO: 8278 - protein, 452 aa, Bacillus licheniformis
MLKLFKPAPPIERLPEDQIDSEYKKFRLQVFLGIFIGYAAYYLIRKNFSLAMPYLIEEGFSKSALGFALSALSISYGLSKFVMATISDRSNPRMFLPAGLILSAVISLLMGFVPFFTSSIAIMFIMLFLNGWFQGMGWPPSGRVLVHWFSVSERGNKTAIWNVAHNVGGGLMAPIAVAGVAIFSGITGSATGYEGVFILPALVAIAVAVISYWLIRDTPQSVGLPPIEEYRNDYSSKSKKTFEKELSTKEILFKHVLNNKWVWAIALANIFVYFVRYGVLDWAPTYLSEEKGFDMSKSSVAYFLYEWAGIPGTLLCGWISDKWFKGRRGPAGFVFMAGVLIAVLVYWFNPAGNPMIDMASLIAIGFLIYGPVMLIGLQALDFVPKKAAGTAAGLTGLFGYLGGTLTANALMGVIVDASGWNAGFTLLTASCAIAALIFAMTWNVRGQEVVKH

SEQ ID NO: 8279 - protein, 626 aa, Bacillus licheniformis
MAKREFKAESKRLLDIMINSIYSQKEVFLRELISNASDAIDKIYYKALTDDSLTFNKDDYYIKISADKENRTLTIADTGIGMTKEELEEHLGTIAKSGSLAFKQENELKDGHDIIGQFGVGFYAAFMVADTVTVITKAHGSDEAHQWESAGADGYTIEPAAKESAGTDVILKLKENTDDENYDEYLDVHRLKAIIKTYSDFIRYPIKMDVAVNKPKEGAENEFEEVQEEQTVNSMVPIWRKNKSELKDEDYEAFYKEKHYGFDKPLAHIHTSVDGAVRYHAILFIPENIPFNYYTKEFEKGLELYSNGVLIMEKCPDLLPDHFSFVKGMVDSEDLSLNISREMLQHDRQLKLIAKNISKKIKNELKSLLKNDREKYESFYQSFGRQLKFGVYNDFGAHKDLLKDLLLFYSSKEKKLVTLEEYVSRMPEDQKYIYYASGDSYDRIEKLPQTELVSEKGYEILYFTEDIDEFAIKMLANYQEKEFKSVSSGDLGIENDDEQNQSDGDDSQYKDLFEEMKKTLDGKVKSVRASKRLKTHSVCLAADGEVTIEMEKILNAMPDNQHVKADKVLEINTNHEVFKTLQNAFDNDKDKFKLYTGLLYNQALLIEGLPIEDPVEFTNDICKVMA

SEQ ID NO: 8280 - protein, 511 aa, Bacillus licheniformis
MSIVHVTNLTHIYGDRMIFQDAGFRLLKGEHAGLVGANGAGKSTLLRILTGSLLPDHGNIEWQPNIRVGFLEQHAKLTEGTTILQYMEKAYGRLFEIEKEMNGLAEKMADAGDNLEAVLKRYGELQAELEASGFYQIGTKIEDAAQGLGLAEIGLDQDVTALSGGQRTKLLLAKLLLEEPDVLLLDEPTNYLDAAHIEWLTGYLKNYEHAFLVISHDERFLNEITTVTFHLEHHVIKRYSGNYQYFLKEYAQIRAQAEAAYAKQNREIKKLEAFIDRNRVRKAKQAKSREKALRKIKRIEKPTDSYVPSFAFKTGRNPAMTVLKTENLEAGYTVPLFKPLSLTVRRGDKIAIIGENGAGKSTLIKTLLGDLKPLSGIVTAGQHLQAAYFRQESPASHDTPLEKLRAFYPDLPEKDIRQTLAVSGLTPKHISQPLFTLSGGEQAKVRLAELMLSNSNLLVLDEPTNHLDASAKHALKQALCDYKGTILLVSHEPAFYEDWVTHIWQIEAWRR

SEQ ID NO: 8281 - protein, 270 aa, Bacillus licheniformis
MYKLIAIDMDGTLLNDLHEVTEEVRNALHAAKKQGVKIVLCTGRPLGGVSRYLEELNLNEDGDYVIAYNGALVQNTHTQEVVSELTLGYDDVKSLYELSQKLDTPMHFFDSAYLYTPNREISPYTVYESYVTKVPLRFRTIEEIPQDLLAPKAMYIDEPEKLDRTIAAIPEDVKERYTMVKSSPFFYEILHPAASKGNAVQQLADILGIAQEEVMCIGDNGNDMSMIEWAGCGVAMGNAIPEVKASADYETRTNNENGVAHAIRELVLSK

SEQ ID NO: 8282 - protein, 349 aa, Bacillus licheniformis
MPRQVTSIAIPAVLDISEGVLGRLDEILRKHQFDKAIMFFDDFSYQQYEHSLKTAFQHVKVEAVLLPSNLDIQELLKRAFSIGNCDVIIAMGGGYVVDCGKYIAFSKRTPFISIPTSASNDGFASSNCSLQVEGKKTTVPARVPYGIIADLSIIQKAPDCFILAGIGDLMSNITALYDWEFEERHGVGDVNAFASMLSKKAVNSFVRTPMQDIKQPIFLKELVSSLTMGGIATEISGNSAPISGSEHLISHALDKISKKPQMHGIQVGVATYIMAHVQDHRAERIEKVFTRTGFFQYVKTLNLNKDEFREAINLSHTVKPNRYTYLHEAGYREKALRILDEDPILQEIF

SEQ ID NO: 8283 - protein, 216 aa, Bacillus licheniformis
MKKWAFVSDFDGTISKQDFYWMVIDKYFPEGRELFKKWKSGELKDIEFLGTVFASINQSEQKIIDDIHSIPIDEYVPDFIQHVQKSGGDFYILSAGTDYYIHYILKKYGITDVEVYSNKGFFKEDNVHMDIDENHWHYSERYGIDKSKVIQKLKEEYETVYFAGDSEPDSHPAKFADVTFAKDALQDLLRQQGVPFVAVETFEDIEQYLKEKGRIV

SEQ ID NO: 8284 - protein, 153 aa, Bacillus licheniformis
MAETNPVIKKLQFKDNGQPVLIVNPPEAYSGVIAEFQGPVHHHAESDQYDFVQVFAATNAKLQALAKEAERHLAEDGLFWLCYPKKSSKVYKGSDCSRDTVAGLLADQGYEPVRQIAIDEDWSALRFRKAENIKTMKRKFAVTEKGKQRTDQE

SEQ ID NO: 8285 - protein, 303 aa, Bacillus licheniformis
MVSACGSGNASNGSKEKAAEETTRTYQSTRGSVKIPTHPKRIVTDFYAGELFTVGANVVGSGSWSFSNPFLKDRMKDVTDLGDPINVEKVMKLKPDLIVVMNDDNYDKLSKIAPTVVIPYNTAKNVQETVKMFGDIAGAKEEAEQFLADFDRKSKAARKKIAQVVDKNATFGIYENTEKGQFWVFNDNGGRGGQAVYNALGLKAPEKIQKDIFKKGEIKELSLEVVPEYAADYMFVTDYNPNGDSKTLDKLKQSSIWKNLDAVKNNRVFINDFDTFYPYDPISVSKQVDLITEMLVKREKENK

SEQ ID NO: 8286 - protein, 133 aa, Bacillus licheniformis
MNENKKAEQERKIGFEGFVLLLSLIFISIFITTAYEIPSNLLLIILFFIGSGYYSIRLVSKGLLRKKRGLGFKAAFSAFVVWMALSFLFHDISYPFSLKGLLFQIMMFFLFYIPFYLIFQFAFRFSSIQERKQ

SEQ ID NO: 8287 - protein, 122 aa, Bacillus licheniformis
MGIEKVGQIGVPVQDLERAAAFYQDVLGLSLLFQTDRMAFFECGEVRLLLSLPEKDEFAHAGSVIYFQVEDLPAVYDEIATKGVSFPIEPHVVAKIEQTETWVAFFEDTEGNTLALMSEVNI

SEQ ID NO: 8288 - protein, 52 aa, Bacillus licheniformis
MLFNITIGALIFSYAAWTLIKFVKRSRKGKCAACELNRTCQSACDDVKTKNS

SEQ ID NO: 8289 - protein, 670 aa, Bacillus licheniformis
MNSRQIALFGNPNTGKTSLFNALTGSYEYVGNWSGVTVEKKVGLLRHKQGMIVDLPGVYTLSPLSRDEGVVTDFLLNDSFSDILNIVDASQLKRNLHLTVQLLEFGHPLTIGLNMIDVAGQRGVFIDHQKMSDALGVPVIPVIARSGKGCDELSRHLLFEKEKRAEPLVINYGSAVEEAIGRIESIIPELPGVLKRWMALQYLEGNSKMKEQLEDAADSERLKEIYEETEKRLHQEHSVRSLHQHIYNERSRWIDRILSTSVQYQSERKLTLTERVDQIVTHQVLGIPIFLLFMYLMFMLTFDWFGVPLSDALDGFIGGPLTEWTASALSAMGASPFIEALILDGIIAGVGGVLVFVPQIFILFFFISVLEDSGYMARVAMVMDRLMEAIGLNGKAFIPLIIGFGCNVPGVMAARTVEQPKERLLTIMLTPFMSCSARLPVYALFAGAFFAAHQAFVVLSLYVLGIAAALVLAKFLSSSKLKEEKSFFVIELPPYRLPQARTLWRATWEKGKGFVRKAGTYIFGGSVLIWLLSYTGPGGTDVAMDDSFLAMIGGVLAPLLLPLGFGTWQAAASLLTGFLAKEVVVASMSIIYFVPEAQLQGMMAEQFTPLAAYGFMAFVLLYVPCLATVAVIKKETNSKKWMFLSIVYGLAIAYAIAFLIYQGGRLLGLS

SEQ ID NO: 8290 - protein, 75 aa, Bacillus licheniformis
MVLAELKQKERARIIDFSDVNELVQRRLIQLGMKEDDEICVKRKLPFGGPFMFESGGQCLGIRLGEAKKIRIEKL

SEQ ID NO: 8291 - protein, 362 aa, Bacillus licheniformis
MQVKEIFVIRCISCLSVVLLHAISMVLMVRADMLGDAVFRVVESFRTLLMFSTPAFIFISEFLLAHAYPGGVPEGFLKKRFKTIFIPFLFIAVLDAFMTAGLMMQQFHASVIIKKLLANIFLGNFIGYFILVIFQFYLLHMCFHSFLQKASPKWVLSISFAVTAAYLSYFTFIQPPVVQEEAPFPFSWVPFPGWLFYFCLAYYCGKNYERFLALLERYRHAVYAAAAVTGCFIVAVSYFGQDIAVTSKRPDILLYSTSIIFLCFHLFSKLKSVPKLIMMISNYSFSIYLLHAFILIFGLVILTALDSIGTVSAVLLLFFISTGAAVFISWAVNKLKYGYMFVGKIYVPKKRRMEQKVRHHAG

SEQ ID NO: 8292 - protein, 628 aa, Bacillus licheniformis
MTFRQFAFNNVIRNKRLYAAYFLSSMFTVMVFFAFAIFAFHPVMTSDSLTSGIGQHASFGLLVAGGIIFVFSFFFVLYSMSSFLQSRKKEFGVLMIQGMSMRQIRMMVFLENMLIGFFATIGGIVLGLVFAKLILLTAENVLIIDNKLDFYFPLMAMIVTFISFNGLFLFISFLVSFVLRSEKLIVLLKGNKISKGEPKASALLTLVAAVLLAGGYYTALIVKEGGVLVAMVPVTIVVIIGTYLLFTQLSVYVIRRLKKRETLFWRKTNMILFSDLSYRMKDNSRTFFMVAIISTVAFSAIGTLYGFQTLVTNGIKEMNPHTFSYKPPETNKHIEKDVAFINDTLDERNIKTDKASAVLQYFDVGGNDMLIVKESDYNKFADLVGADHVKLEDGKAAAAEYEVKIGLEGDDDQQLPSSIPFANGKQLKADQTIRSKALSEPSYYIVTDKDFAQLKKPKSENRFYAWQAKEADGMALVKAGEALQKKLDYMYFGAVDYEVYNISKGYGPILFVGLFIGIVFFVSAGSFLYFRLYTDLDDDKQKFKSIAKMGLTDRELHKVLNRQIGILFFAPIAVALVHGAVALTALSHAFQYNLFKESAMVLGVFFAIQVIYYFIVRFYYTKQIKAAI

SEQ ID NO: 8293 - protein, 254 aa, Bacillus licheniformis
MLQVKQASKIYEGKIAYRALTDINLTIDKGEFVGIMGPSGSGKTTLLNMIATIDEPTTGEILISGQNPHVLKKEKLAKFRRRELGFVFQDFNLLPTLTVEENIVLPLTLDGEKVKEMKRRANELAEKLGITQIMKKRTYEISGGQAQRAAVARAMIHSPKLLLADEPTGNLDSKSSKDVMEMLESINRNEKATMMLVTHDPQAASYCNRVVFIKDGKLYSEINRGDNRQAFFQKILDTLSLLGGDANDLSSVRV

SEQ ID NO: 8294 - protein, 335 aa, Bacillus licheniformis
MKLFFKEHYLLIAVQALQFITMLSVYWLDGYQHIRPAFYAVFLGFFFLGFYLFYHYYTRRKFYKRMTSGLESLDDTFRQSNQPQSPLSEALEQLLKSQYKQYRQELKKLELGQKEHLTFMDQWVHQMKTPLSVIELTAQNLDEPESSSIREETERMKTGLNTILYMARLRTIEQDFRIKPVALADIVHEVNRENKRFYIRSQVYPKFKEIKKGITVETDEKWLFFIISQFVNNAVKYSAGKSNTVIISVYENDSEAVLEVADFGAGIPDTDQKRVFDPFFTGENGRRFRESTGMGLYLAKSAADQLGHRIELDSQEGKGTTIRLIFTATQNLTSM

SEQ ID NO: 8295 - protein, 235 aa, Bacillus licheniformis
MQKVMIVEDDPKIADLLKSHIVKYGYNVHVVKDFDRVMDEFRSTAPDLVLLDINLPSFDGYYWCRQIRQESICPVLFISARTGEMDQVMALENGGDDFITKPFHAEIVMAKIRSQLRRAYGEYAAKAEERLLEKEGLRLYPERLELTFAGQTAALTKKEADIIESLMERHPRISGREDLLAKLWDDQAYVDENTLNVNITRVRKKFQELGIEDAVETVRGAGYRLNVSWVKAGEE

SEQ ID NO: 8296 - protein, 123 aa, Bacillus licheniformis
MKTRAGGLIAAVLIAVAGVFILQKATGGLVPLADDYIQGQGKPEAYYLKAEDHAEKPDNGKYNYTLTGYDASGHKQQIEAEADEKLHPGAFIKVLAYGTKAKSLTEVHEEEIPEGALAAMKTN

SEQ ID NO: 8297 - protein, 561 aa, Bacillus licheniformis
MKVKTKLLGIISILVVSILGIGISSVFMISSTVKKNEELKDKMEFQKEIKHIQYRLTGLSNDERALIMTGDDEYSEGMKDKADDVLKSLDRAGKLIREKSYKANVEEIKENFKAYWDLNQQVMQTYASSLKKAESIHFGEERTLRKDVLDPSVNQLVESLEQEVDDLKAEIRANGTMSEWVIIAVTGVSAILGIVLSLLLLKSILVPLRSLNQQLEDIAHGEADLTKKVIVKNKDEFGQLANSFNAFVQSLTQIVKQISSSSEQVAASSEQLSASAEESKSTSELISEEMQAIADSNMTQSEMTEKSSEAIHELLDRLSSVASNTGSIADLSSSMRDKAEIGSESVHKMLEQMNFIDKSVDSAGSGLQALVSSTAEISNISSLITDISEQTNLLALNAAIEAARAGEQGKGFAVVAEEVRKLADETNKSASHIQSLVTTIQNESVETVNNIKVVQENVSSGIALSQETTGNFNEILNLVEQVASQIQEVAASTQQLTSGVEMVQNTIQTLASGSQETSASTKAVASSTQEQLASMEEISYAAESLSQLAEELQTIINRFKY

SEQ ID NO: 8298 - protein, 474 aa, Bacillus licheniformis
MDILEILGKINKVLWGPPSLILLFGTGLFLTIVLKGLQFRRLIYAFKIGFGKEDSKDAAAEGDVSHFKALMTALAATIGNGNIAGVATALTLGGPGSIFWMWVVGLLGMATKYAEALLAVKFRVKNEKGEYSSGPMYYIEHGLGRKFKGLAIAFALFGAFAALGIGNSVQSNTIADITKNSFGIENWVTGLILVILVSVIIFGGIQRISTVASFFVPIMAFLYMGGAILILILNYDKIIPAFALIFYYAFHPVAAAGGFLGIAVSEAVRNGVSRGIFSNEAGLGTAALIAGNARADHPVKQALVAMTGTFIVTIVVCTMTGLTLIITGFWDPSGGLISGVAHNASLEGGALTSAAFASVLGAAGEYIVSLSVIFFGFSTIVGWYVYGEKCFEYLAGAKGIAGYRLVYILACGIGTVANLVTVWAFADMANALMMIPNLIAILLLWKVIKAETNDYFHHFYEHTKSAGPPSKPIH

SEQ ID NO: 8299 - protein, 376 aa, Bacillus licheniformis
MIIGIPKEIKNNENRVAITPAGVVALKKSGHQVLIEQGAGLGSGFEDADYKAAGADILAEAKDVWGKADMVMKVKEPISSEYGYFRKGLVLFTYLHLAAEPKLAKALVDSGVTAIAYETVEVNRTLPLLTPMSEVAGRMASQIGAQFLEKSKGGKGILLSGVPGVKRGKVTIIGGGVVGTNAAKIAVGLGADVTLIDLSAERLRQLDDQFGKDIQTLMSNPLNIAEAVKDSDLVIGAVLIPGAKAPKLVTEEMIKSMSPGSVVVDVAIDQGGIIETVDKITTHDDPTYTKHGVVHYAVANMPGAVPRTSTIGLTNVTMPYALQIANKGVEQAVAENQALALGVNVANGSITYKAVARDLGYEYVSVEDAFQTVTAG

SEQ ID NO: 8300 - protein, 425 aa, Bacillus licheniformis
MMKNVLAVFVVLIFVLGAFGTSGPAEAARDSGTAKSGLYVEKVSGLRKDFIKGVDVSSIIALEESGVAFYNESGKKQDIFKTLKEAGVNYVRVRIWNDPYDANGNGYGGGNNDLEKAIQIGKRATANGMKLLADFHYSDFWADPAKQKAPKAWANLNFEDKKTALYQYTKQSLKAMKAAGIDIGMVQVGNETNGGLAGETDWAKMSQLFNAGSQAVRETDSNILVALHFTNPETSGRYAWIAETLHRHHVDYDVFASSYYPFWHGTLKNLTSVLTSVADTYGKKVMVAETSYTYTAEDGDGHGNTAPKNGQTLNNPVTVQGQANAVRDVIQAVSDVGEAGIGVFYWEPAWIPVGPAHRLEKNKALWETYGSGWATSYAAEYDPEDAGKWFGGSAVDNQALFDFKGRPLPSLHVFQYVDTGTPFKN

SEQ ID NO: 8301 - protein, 684 aa, Bacillus licheniformis
MPKIYTTQARYMLHGGDYNPDQWLDRPDILADDIKLMKLAHTNTFSVGIFSWSALEPEEGVYTFEWLDDIFESIHRNGGRIILATPSGARPAWLSQKYPEVLRVNAERVKQLHGGRHNHCFTSYVYREKTKEINRMLAERYGSQHALLMWHVSNEYGGECHCDQCQHAFRDWLKKKYNHDIKSLNDAWWTPFWSHTFNDWSQIESPSPIGENAVHGLNLDWRRFVTDQTISFFQNEIVPLKEITPNIPITTNFMADTHDLIPFQGLDYSKFAKHLDVISWDAYPAWHNDWESTADLAMKVGFINDLYRSLKQQPFLLMESTPSAVNWHDFNKAKRPGMHLLSSVQMIAHGSDSILYFQWRKSRGSSEKFHGAVVGHDNCSENRVFKEVAKVGQTLEALSEVTGTIRPADVAILYDWENHWALQDAQGFGMKTKRYPQTLHEHYRAFWERDIPVDVITKEQDFSSYRLLIVPMLYLASEETIARLKAFAANGGTLVMTYISGIVNESDLTYLGGWPKDLQEMFGMEPVETDTLYPGDKNAVRYQNRSYELKDYATVLKLSTADPEGFYEDDFYADTTAVTSHPYKQGKTYYIGARLSSQFHRDFYGTLIKELAIQPALDVKHQPGVSVQVRQDEENDYIFIMNFTEKRQPVVLASAVKDMLTGETLAGEVTLEKYEARIAVKAKE

SEQ ID NO: 8302 - protein, 279 aa, Bacillus licheniformis
MKKRRFFRLLLTYSLLAFMTAVIIYPLLWTVGVSFNPGNSLVSTSIIPANPTLDHYKELFAGKESLQYGQWYINSLKISIFTMIGSVISVSFTAYAFSRFRFKGRKNALVLFLLLQMIPQFSALVALFVLAQMLGMMNSHWLLILLYIGGLIPMNTYLMKGYMDSIPIDLDESAKIDGASNTRIFLQIIMPLSKPMIAVVAMNGFTGPLGDFVLSSTILRTPESYTLPIGLYNLVNEVMGASYTTFAAGAILISIPVAVIFIMLQKNFVSGLTAGGTKG

SEQ ID NO: 8303 - protein, 418 aa, Bacillus licheniformis
MQHRKKALLLSIIPGLGQFYNKQWIKGLLFLLLGVSFFAVFGDLLNMGLWGLFTLGTEVPRDNSIFLLAKGIIAVIVTCFGLAVYYANLRDAYQNGKRRDEQKELSSLKEQYHNLIAQGYPYLISGPSLFILVFAVVFPILFSFALAFTNYNLYHSPPARLVDWVGIKTFSEIFTVDIWRSTFLDVLAWTIVWTLVASTLQVGLGILLAVVVNQKEVRFKKIFRTILVLPWAVPGFVTILVFAGLFNDSFGAFNHQILAAFGIDPIPWMTNANWTKLALILMQGWLGFPYVFIVTTGVLQSIPDDLYEAATIDGASAFSKFRHITLPLILIAMAPIIITQFTFNFNNFNIIYLFNGGGPAVPGSTAGGTDILVSWIYKLTMQSSQYSLAAALTILLSVFVISIALWQFRRTNSFKEGA

SEQ ID NO: 8304 - protein, 422 aa, Bacillus licheniformis
MMNMKKYVGISSVIALSLSLTACGPKESSNGASDSKQKELVVWEDKEKSEGIKDAVAQFEKEHGVSVKVVEKPYAKQIEDLRMDGPAGTGPDVLTMPGDQIGTAVTEGLIKELKVDKEIQSIYTEPAMRSQVTNGKVYGLPKAVETTMLYYNKDLISEKELPKTLDEWYEYSKKTADGKKFGFLALFDQIYYAQSVMGGYGGYIFKSDADGTYDPADLGLNNKGAVEGAEYIQKFYQEGLFPAGIIGEQGINVLESLFTEGKAAAIISGPWNLEPFKKAGINYGVAKLPKLSNGKHMSSFVGVKSYNVSAYSKNADLAEQLVVFLANKENSKKRYEITKEVPAVKELADDPAVTKSEAAQAVAEQSQYSELTPNIPEMNEVWTPADAALQTIATGKAEPKKALDQAAETIQGQIKAKHSGSK

SEQ ID NO: 8305 - protein, 330 aa, Bacillus licheniformis
MATIKDVAEKAGYSISTVSRVLNNDESLSVPDETREKKFEVAESLNYRKKTIRTLVKNIAFLYWLTDKEELEDVYFKTMRLEIEKLAKQFNVELATYKISGGIDAIPENIEGFIAVGSFSDDELIRLRQMTPHGVFIDSTPDPNHFDSVRPDLKQMTRKTVDFLIEKGHEKIGFIGGTYHNPNTDEDEMDVRERTFREYMKEKGLLEESFIFCRRGFSVENGYHLMDKAVETLGEKLPTAFFTAADPIAVGCLQALNEKGIAIPGRVSIISINNISVAKYVSPPLTTFHIDIKELCKNAIELLLEQILQKRKAVKTLYIGAELVVRKSTN

SEQ ID NO: 8306 - protein, 389 aa, Bacillus licheniformis
MNTAAALSNDFRSIFKTEKTPRTFFAPGRINLIGEHTDYNGGHVFPASISFGTYALGVKRDDQMIRFYSKNFPDKGIIECSLSDLAFDQSDGWANYPKGMFLLTKAAGHQIVHGADILYYGNIPHGAGLSSSASIELATGVLLKGLYDLQTDTISMVKLGQKVENEYIGVGSGIMDQFAIGMGKKDHAILLDCRTLDYTYAPFVLKEHDVIIINTNKQRTLAGSKYNERRTQCEEALGDLQQELSIASLGELTMEGFEAHQHLIRNEINQKRAKHAVYENARTLKALEKLREGDLAGFGKLMNESHLSLRDDYEVTGLELDAIVQAAWEQDGVLGARMTGAGFGGCAIAIVEKDRTDSFKERVNAVYRETVGYDAAFYTAAIGDGAKEI

SEQ ID NO: 8307 - protein, 333 aa, Bacillus licheniformis
MSVLVLGGAGYIGSHAVYQLIDRGENVVVVDNLETGQRQAVHPDAIFYEGDVRDRDFLRTVFEKERIEEVIHFAASSLVGESMKDPLKYYDNNVSGTQVLLQAMLEHDVKKIVFSSTAAVYGEPESLPITEDMPTMPTSTYGETKLIMEKLMKRTEEAHGISFVSLRYFNVAGARETGEIGEDHRPETHLVPLILQTALGQRPHITIFGDDYDTPDGTCIRDYVHVEDLIDAHLSALDYLRKGGKSDIFNLGSSEGFSVKEMIDAARKATGKDITAEIGKRRAGDPSILIAGSHKAKQVLGWRPSRTSVAKIIEDAWKWHSSHPNGYRKEVST

SEQ ID NO: 8308 - protein, 495 aa, Bacillus licheniformis
MIEQDIAGLIQKALEAGFIEPADVNYARNQVMNLLGLESFPEEATAASGDSIPDLLEKLAAYAVEHGVITDDLDAKDMLAANVMNCFVARPSVINAVFQQKYEQSPLAATEYFYQLSKNSNYIQTKRIEKNISYQMDTPYGTMDITINLSKPEKDPEQIKRERAAAKQSRSYPMCLLCKENEGYAGRIGYPARANHRIIKVPLAGENWYFQYSPYAYYNEHSILFSEQHRPMKIDKLAFHRLLAFTELFPHYFIGSNADLPIVGGSILSHDHYQAGRYEFAMTRAEGAFSFQIKQHPAIEASVLKWPMSVIRLKGTAINSLVEAADHIFQTWKNYSDQQADISAFTDGTPHNTITPIARNVSGVYEIDLVLRNNRTSAEHPYGIFHPHADVHHIKKENIGLIEVMGLAVLPPRLKTELAAVKEFLLGQSDAVEAHHREWAEQLKTEYGELSEPEQAESIVRKELGKKFVKALEDAGVFKDREAFMRFIRTVNHQG

SEQ ID NO: 8309 - protein, 390 aa, Bacillus licheniformis
MQRGTFQLMKSVNKSIILNKIRTSEPISRAEIAKETKITPPTVSSIVKELIGQGLVKESTLGRSSGGRKPTMLHINTGAYYVIGIDAGPETVECVLTDLAGGILQRTSSLLKKPLTNERFMEVLKESVYAILGRADVEQEKIIGIGIAMHGVVDAETGMSRIAPILNLTNIPIKDVLEQEFNLTVRVENDARAMALGESWFGGRDDAGSMAAVNIGRGVGAGIVINGKLYHGAEGIAGELGHMIIDINGEKCECGNRGCLQTIVSGKAIAERGKKRLKESTDSLTAKDLFEMAENGCQTCIELFQETGVIIGIGLTNFIHLVNPGKIVLGGGVMKGGRFILPAIRETIQQKALTAEARQTEVTITKLGDEATLYGAVSLLLAELFDPVLK

SEQ ID NO: 8310 - protein, 243 aa, Bacillus licheniformis
MSESKGLLYPEKWLSRASTGVRVACELRMRIISGLIESGTILSENKLAAEFSVSRSPIREALKILASEKIIRLERMGAVVIGLTEKEIGEIYDVRLVMETFVFERLGQANVDELVTDLSKILEMMKVSIKYKDADEFSFQDVLFHETIVRSINHSYILMIWNNLKPVMESFILLSMRARLKEKYEDFERILDNHELYIQAIKTKDRDLMLKSLHQNFDDVQGKVEDLWLSQQMLAKGAEQQND

SEQ ID NO: 8311 - protein, 513 aa, Bacillus licheniformis
MTSYMLGIDIGTTSTKAVLFSEKGDVIQKESIGYPLHTPDISTAEQNPDEIFQAVIQSTAKIMQQHPDKQPSFISFSSAMHSVIAMDENDKPLTSCITWADNRSEGWAHKIKEEMNGHNIYKRTGTPIHPMTPLSKITWIVNEHPETAAKAKKYIGIKEYIFKKLFDQYVVDHSLASAMGMMNLKTLAWDEEALAIAGITPDHLSKLVPTTAIFHNCNPELAAMMGIDPQTPFVIGASDGVLSNLGVNAIKKGEIAVTIGTSGAIRTIIDEPQTDEKGRIFCYALTENHWVIGGPVNNGGIVLRWIRDEFASSEIETAKRLGIDPYDVLTKIAERVRPGADGLLFHPYLAGERAPLWNPDVRGSFFGLTMSHKKEHMIRAALEGVIYNLYTVFLALTECMDGPVARIQATGGFARSDVWRQMMADIFESEVVVPESYESSCLGACILGLYATGKIDSFDVVSDMVGSTHRHAPKEESAKEYRKLMPIFINLSRALENEYTQIANYQRSLTSKK

SEQ ID NO: 8312 - protein, 448 aa, Bacillus licheniformis
MPLLIVAIGIVALLLLIMGLKLNTFVSLIIVSFGVALALGMPFDDIVKTIEQGLGGTLGHIALIFGLGAMLGKLIADSGGAQRIAMTLVNKFGEKNIQWAVVIASFIIGVALFFEVGLVLLIPIVFAISRELKISILYLGIPMTAALSVTHGFLPPHPGPTAIAGELGANIGEVLLYGIIVAIPTVLLAGPLFTKLAKKIVPQSFEKMGSIASLGEQKTFKLEETPAFGISVFTAMLPVIIMSISTIITLIQETMGLADNSFLAAIRLIGNASTSMVISLLFAIYTMGIARKIPIKQVMDSCSTAITQIGMMLLIIGGGGAFKQVLINGGVGDYVAELFKGTAMSPILLAWVIAAILRISLGSATVAALSTTGLVLPMLGQSDVNLALVVLATGAGSVIASHVNDAGFWMFKEYFGLSMKETFATWTLLETIIAVAGLGFTLLLSLFV

SEQ ID NO: 8313 - protein, 467 aa, Bacillus licheniformis
MCNTIGVIGLGVMGSNIALNMASKGEQVAVYNYTRDLTDQLVQKTGGQTVKPYYELEDFVQSLEKPRKIFLMVTAGKPVDSVIDSLVPLLEEGDVIMDGGNSHYEDTERRYDSLKVKGIGYLGIGISGGEIGALKGPSIMPGGDRDVYEKAAPILTKIAAQVDGDPCCVYIGPKGAGHFVKMVHNGIEYADMQLIAEAYTFLREKLLLPIDEIADIFDTWNQGELNSYLIEITAEILRKKDEKTGAPLIDVILDKTGQKGTGKWTSLQAVDNGIPSSIITESLFARYLSSLKDERTAAEKVLAGPATEERRLDQNVWIDRVRQALYMGKICAYAQGFAQYKMTSDLNGWNLPLKDIALIFRGGCIIRAQFLNLISEAFDKQPDLSNLLVAPDFAEKLKEYQSGLRKVVCEGISSGISFPCLSTALSYYDGYRTGRSNANLLQAQRDYFGAHTYERTDMEGVFHTDWY

SEQ ID NO: 8314 - protein, 867 aa, Bacillus licheniformis
MAIEEKNMKQKQNASNMIDQLVEKGLKALEEFRSFDQEQIDEIVKQMALAGLDQHMPLAKLAVEETKRGVYEDKIIKNMFATEYVYHHIKYDKTVGIINENEHDGVIEIAEPVGVIAGVTPVTNPTSTTMFKSLISIKTRNPIVFAFHPSAQKCSREAARILRDAAVKAGAPDNCIQWIETPSLDATQALMTHPNVSLILATGGAGMVKSAYSSGKPALGVGPGNVPCYIEKSANLKQAVNDLILSKTFDNGMICASEQAVIIDKGIYSDVKAEMTRNNCYFLNKTEKSKVEKLVINENTCAVNADIVGMPAFKIAEMAGIKVPQDTKILIAELEGVGPDDPLSREKLSPVLACYKVSGLEEGLKRAEEMLAFGGTGHSAVIHTNDQEAVKEFGLRMKAGRIIVNAPSSQGAIGDIYNAYMPSLTLGCGTYGGNSVSSNVGAVHLINTKKVAKRNVNMQWFKVPPKIYFEKHATQYLAKMPDISKAFIVTDPGMVKLGYVDRALHYLRRRPDYVHCEIFSDVEPDPSIETVMNGVDMMAKFQPDVIIALGGGSAMDAAKGMWMFYEHPDAEFFGLKQKFLDIRKRIVKYPKLGGKAKFVAIPTTSGTGSEVTSFSVITDKETNTKYPLADYELTPDVAIIDPQFVMTVPKHITADTGMDVLTHAIESYVSCMANDYTDGLAMKAIQLIFEYLPRAYKNGSDELAREKVHNASTIAGMAFSNAFLGINHSLAHKLGAEFQIAHGRANAILLPHVIRYNAAKPKKFTAFPKYSHFIADQRYAEIARTLGLPAKTTAEGVESLIQEIISLAKELKIPMSIKQNGVDAAAFESKVDLMAERAFEDQCTTANPKLPLVSELAEIYRSAYKGV

SEQ ID NO: 8315 - protein, 187 aa, Bacillus licheniformis
MSLIGKEVQPFAAKAYKNGEFIDVTHEDLKGQWSIFCFYPADFSFVCPTELEDLQNHYEALKELGVEVYSVSTDTHFVHKGWHDSSEKIGKITYAMIGDPSQTISRNFEVLNEEEGLADRGTFIIDPDGVIQAVEINAGGIGRDASILINKVKAAQYVRQNPGEVCPAKWEEGSETLTPSLDLVGKI

SEQ ID NO: 8316 - protein, 509 aa, Bacillus licheniformis
MVLEANIKAQLNQYMQMIENDIVLKVSAGDDSVSKDMLALVEELASMSSKITVEKAQLDRTPSFSVNRAEEDTGVTFAGVPLGHEFTSLVLALLQVSGRPPKVDQKIIDQIKNISGEYRFESYISLTCHNCPDVVQALNMMSVLNPNISHTMIDGAAYKSEVESKNIMAVPTVYLNGESFGSGRMTLEEILAKMGSGTDASELSDKEPFDVLVVGGGPAGASAAIYAARKGIRTGIVAERFGGQVLDTMSIENFISVKRTEGPKLAASLEEHVKDYDIDVMNLQRAKGLEKKDLFHLELENGAVLKSKTVILSTGARWRNIGVPGEQEFKNKGVAYCPHCDGPLFEGKDVAVIGGGNSGIEAAIDLAGIVNHVTVLEFAPELKADKVLQKRLYSLPNVTVVKNAQTKEITGDENVNGITYVDRETGEEKHVELQGVFVQIGLVPNTEWLPETVERNRIGEIAVDKRGETTIPGLFAAGDCTDSPYNQIIISMGSGANAALGAFDYLIRN

SEQ ID NO: 8317 - protein, 209 aa, Bacillus licheniformis
MYFSAKKKIRGWKRLKRRIEWWKSDNIQLNMEYLRDHHRDYVKLWISPFYGLQTVTPPLWYKRLLLEAMIDVYHEWHKQLKAENEDFYLKIWLYEPDFIRSQIVAAYKEAIDFYSGSFDKQEEKEAFSLKIYEPLEHELNAFEWEPHIHTVYYRLSDLEEDLELGLRSSGDVLRIKEMSYSKDNDGKDEWYKVSAGTVWVGSLKEVPQK

SEQ ID NO: 8318 - protein, 338 aa, Bacillus licheniformis
MVFKKPKVFIAAVILALSSFAGTAAYAQSGYFNTYTDYVSMSKSGYFTAMQGMCVDRNNNVIYAAKLNNTNHTTQLFSVKMSGTASNRTVALLKNSDTNTTSYDLGHANDLAVKASAGDKSVSVYVAPMSDGTKYANKIVKLSVDTTKNTYKVAKTYVLNYQGSNLSIGGITYSVGTDKFIVRSGKRFFIGTFNDTTGKFDYEATFKLNYSKAVVNHQTMDVSHFIQQGISFYQGTLYVPLTKPDSNGNASNVSIILTYPLNINEMIKEQKTNPIQDFSKELFTRSDLSFRITSSAYTLFEIEAVDFDDGTLYFNTNRGKSGTQNDMIATFNDYNYYK

SEQ ID NO: 8319 - protein, 86 aa, Bacillus licheniformis
MNELVFEKREFTQDHVNVVKAMHINNYPIVYILYNEKKKPTAYIGQTVQAARRLKNHIDDEKRKSLNRFILIGHEKFHQSATYNIE

SEQ ID NO: 8320 - protein, 298 aa, Bacillus licheniformis
MSNVVSLTNVTKTFRQKTAVDQIDFSIKKGEIVAILGPNGAGKTTTISMILGLLKPTAGNITLFDSMPHEKRVREKIGTMLQEVSVMPGLRAGEIIELIRSYYPKPLSFQKLRTLTGLTDKDLKTQAEKLSGGQKRRLGFALALAGDPELMIFDEPTVGMDITSRNRFWQTVQSLAEQGKTIIFSTHYLQEADDAAQRILLFKDGKIVADGTPLQIKSRISKHSVSFIVDPEQSLEKLYQHPETEQIFRKNNRVYIDTANTDKILELIFSEKIGAYDIQIERGNLEEAFRQLTSKGDE

SEQ ID NO: 8321 - protein, 171 aa, Bacillus licheniformis
MVQERTQGWSTFIRVTPLPDHIYFIAQMSGQSVIHILSITVIFLAGALINGVSLSPLEWFLCGLWALLGSLPFLAIGTLIGMMKKVDTAAGISNVLYMGLAVCGGMWMPLEIMPKMMQNIGHWLPSYHYGSGAWEIARGQMPNWKNILFLLAYSIVIMLLSKYIRRKQEAV

SEQ ID NO: 8322 - protein, 380 aa, Bacillus licheniformis
MKKNFSMFPKRYGFFPYIFLIYLLLPISYLTNQTSGIKQLIGFGLVLLFLVTYRQLFFIPPQKKLFTYWLAIQLSIILIYTVFYDINLVFLGFFSANFIGYYREKKTFRCGLASLVVVLVAPFIYHLLKDPSLLNRLFYFLPFLVIMLISPYGIRSMNRRMELEQKLDEANQHIKELVKREERVRIARDLHDTLGHTLSLLTLKSQLVQRIIASAPERARKEAREMETTSRAALKQVRELVSDMKTATIAEELIHIQQILRAADITFEYMGGSDFSNIPPVTQNIVSMCIREAATNIVKHSRATHCTISISQTDDKISITIKDDGMGMDQQKTPFGNGLRGMKERLALIDGALDVSTHDGTVLSIAVPNVKKAEGKEAIQ

SEQ ID NO: 8323 - protein, 200 aa, Bacillus licheniformis
MIRLFIAEDQRMLLSALGSLLDLEEDMEVIGQATNGEEALTAILKLEPDVCLMDIEMPVKSGLEVAEELAKQGAKTKIIILTTFARPGYFERAVKSNVHGYLLKDGEIDDLADAIRKCTEGKRTFSPELTFNAVRETNPLTEREQDILRLAYIGKTTKEISEELFLSSGTVRNYISEIMQKLDAKNRMEAARIAEGKGWI

SEQ ID NO: 8324 - protein, 662 aa, Bacillus licheniformis
MEVQLVYKRIIVAVAGALFALLALLAAIITDLYDRDFPQAIGAESRLNLDFSESGLSITEAFAKLEKLDARWNLGLVKVAPDLASDGDGQVYVALNDRDLPDEFTWFGGDGAGKIVGKDRLETSYPDGFYLVTGEKAHLSEFEDTLKSEGVKVGRGDASIFKSLEFVVRERGFAAAVLAAFALIAALALFWLSLRARGRALRVLGGCPTSRIQVQDLAGFGGALLVSAVAVALVASCYVGLFHGWIYVGTFLNALFSLQVAVITVSLLATLIMSASAWPSATMIATRQPAVKSLRSAAIVIQALTFLLVVAAAGPAWSAYKHSSAIAAEMAQWKKLADQVAIVFATDVDEMNHMEPLIGKLVKDAESLDKVAFSYTYTQEMPMPADFGEYSAISYVNQRWLDMVTMDAPQPAVTKVPYHSIPKGLVKMIREEAELLSRKELSDEQFGKFKFLRPIDGFRLPVAQGGGGERLHFADDVLVVVVPSLYDTYNDSALTSMVSGSNIVFTGVTATQELLGKHGLDVKALRDRDINGELKVVYVAEEGILRAQFAAYVVWLLNLALIALVIAFTVAAAISALITALLQAKRDFPLRVAGQSWVRILRSRVAKEMLVGVGLVGVVVLLQRPDEIGAVLVAAVYGLLVVPLSHLFAVRWCFDRASKRRI

SEQ ID NO: 8325 - protein, 118 aa, Bacillus licheniformis
MKSTTKIIIGVVIGLLLAVGTIAFLNGWITVSRDTHPPCDQLPNVTEANAALSRHQDLVEEIKALGDDITVEVGKPCPDDENRGLVMVSYGSRSEHDAISDLLSRRDGFGVPVHLVKR

SEQ ID NO: 8326 - protein, 230 aa, Bacillus licheniformis
MIEAQGISVAIGGRTVLDGETVQCPPGVMTALVGPSGCGKTTLLHCLGLLLPVNQGRILIDGHDVTSYGTAARRRFWRDHAAFILQDYGIMDEESVAFNVTMQASILGRRVTGNQERLAQVLEQTGLQGREGELASHLSGGEKQRLALARAIYKDAAFLFVDEPTASLDSTNRRKVIDLFADFAARGRTVIVSTHDSEMINACGARHKVGSSSSSKPLSTNDPGNLGGNS

SEQ ID NO: 8327 - protein, 126 aa, Bacillus licheniformis
MKNHLYEKKKRKPLTRTIKATLAVLTMSIALVGGATVPSFAWVNPGYHYQYPSEGGTWRYGFVNAGLRSEYNHPTKVHGSTVQKLIDGKVDKTNRSIDTAAGRYSNAYVGAINSPGLKGRYYYRTN

SEQ ID NO: 8328 - protein, 52 aa, Bacillus licheniformis
MVEEVKEADVKDEGLLSLFPKTIRRKIQYRRNRLAKANAALQELEERTPEEK

SEQ ID NO: 8329 - protein, 42 aa, Bacillus licheniformis
MIWDSVLDNIETKQVKRQTTTADAKHYSPENILPKKQIKQDT

SEQ ID NO: 8330 - protein, 328 aa, Bacillus licheniformis
MTLIERWSKEYLEMDASYENHINKFVNFIKKINKADKPTKININDVEDCIGHYNELGQINTVSSMENHLESIKSFYKFLVSKAWSTDIFVELYDYQGYKKYLTDKFNLEETKEREFFDQDVIKKIISCLDDYFDSRVLADLSGQKRKRYMSYVLLRLFIKLTLIVPAKRAIICNIKKADFSTDYRTITINDVQINIPNGLRKEIIINIKLVEKLKDKKMDNSDRLFYFLNESSFRPEDLNSWFCNLLREFNIIDISEDKSTYPVETIRNSVIVELILKGFDLALISKVSGVSISTLENRYYKVKSYEAEELNKLINEGIAGIPYYSYI

SEQ ID NO: 8331 - protein, 450 aa, Bacillus licheniformis
MLGEKFEEFVDGLQIASIEEETKRVKEITKRLNKSFRDLDNEEIENSHIVGSLGRDTAIKTFSDVDMLYVLPKELKNQYDEYEGNGQSKLLQKVKQEIKKRYPKTIVRGDGQVVVVSFESINKTVEVCPCFERTDGAYDYPDSNNGGSWKKTDPMPEIDESIKVIDETNSNYKYVCNIVRAWKNNKGFKFGGLLIDTLVYNFFNENENYKDSTFDDYLSLLKDLFYYLKTRNKDQKYWYALGSNQKVYNKGGAFVNQAKKAYEKIKDKTEDSEDLYEKLQDIFGKAFPIPEEIQESNVIEKSALFGRSVRQTEEFIEHKFDVDIRYHLKIDCIVKQDGFRNKFLRNILRDKLPLKANKSLEFFITENEFETLSKDDEDNLYYEVYWKVLNRGEEAIRRDCIRGQIVRDKGTHKKFESTNFKGEHYVECYIVYKNVCVAKDRISVPISTIN

SEQ ID NO: 8332 - protein, 194 aa, Bacillus licheniformis
MERNLFLRQLAENGYNVIYGAKKHFSTYDTVVKMPGRIAFITLAIGIWQIYKPSFPYNSEISLLLIIASIIALTISQYNSEKDRYREVGNRLIQIHNELREIYYQAKSSEQENFSNESNEAIRMNELLNEFYQISISKQIFLSDWVAHYKLFFQSQYEWIDEQKKFTWKDKIPISFRIAVIGFIAFIILLIIVL

SEQ ID NO: 8333 - protein, 164 aa, Bacillus licheniformis
MNKDKFQTTDSKSRVTFVNELLKREDFDLQKVADVLEMNYSTFTKLMQEDDYVYIKRENQYYKFVRDESQIFTISDQTDSEMDYIKANFSLLKSIIERYKHKDDFIIDKRIFRSTSKTSSKNFRMPDDLYQNFVATCENEFPHLKIQDIIAQLLLDFTDKYSDK

SEQ ID NO: 8334 - protein, 304 aa, Bacillus licheniformis
MIQGKSYIRSIEKYIKLVDGVFRLGVKITNENKEKIEKIGFPAFEAGQAMFPPIVGRFTRFNVEGKEIIRRDLPKETIYVSMYSTRKEFRGRDQTEEVTDFVDIPRQVYKKEIIPGTGFEIVIEAKGDDLFLLINETFNKETDSEIATVGANIILELVGYCEVFSEQLDTYYKPSYLKRYNWIFLESKELPWEERKERFKEIVESSKKSKQMVIWERLETIVQYKPDFEAIGQNGFSGYVVFGFKDKELYVFESANVGNATYIVKGDWESVSKMSKAEIIKNNLHEWRLIHRNDWKGKVKKVLG

SEQ ID NO: 8335 - protein, 241 aa, Bacillus licheniformis
MERHQIQYGNKCIDFMLERKNVKNVNLNIKPDRTIQVSANDKVPIDFIYDFVKSKGAWIVKNVKTFEDVLPHKQSEREYVSGESFRYLGKQYRLRVEKTEDEEMVKYFRGFIYLYVQNPQNYKRKEKLMDGWYREKALKIFQESLDKMSLYMQKYGVEKPSLDLRLMKARWGSALVDKNTILLNTELIKAPKHCIDYVVLHELIHFKYNDHSDNFYKMLYTLMPDWEKRKTILDEEIVQEL

SEQ ID NO: 8336 - protein, 1035 aa, Bacillus licheniformis
MSIPQSYDERYISQQPAIEVLQGLGYEYIEAERAEAMRENLYSVLLKTVLENKLKELNSYQYKGVTYKFSEANIQQAMRDLDEPLTNGLVKANESIYETLMLGRTYTELLPDGSKKSFTIQYIDWENVENNVFHIVEEFSVERVDGRGTVRPDIVLFVNGIPFAVIECKKASISMEQGISQMIRNQKNDYVPQLFKFVQMVMATNKNETKYATCGTPKKFWSVWKEEHEEWLDHWLHQTVENRLPTMQDKNIISLFHPERLLELTCFFTLFDKDVKKVTRYQQYFAIKEILTTIQERDENGNRQSGVIWHTQGSGKSLTMVMLARYILSELNDYHPKIIVVTDRVELDKQIHKTFNHTRLKASRATSGSHLVSLIKDGNADIVTTLVHKFDTASTKQQPIESRDIFVLVDESHRSQYGELHIKMRKVFPNACYLGFTGTPLMKKEKSTMIKFGKLIHKYTIADGVKDRAIVPLLYEGKMVDQTVNKTAIDNRLSMITRHLNDKQKDEVMKKWSHFERIASSDQRISMVAFDINDHFYRNYKTQGSQFKAMLATNSKMEAIRYLEAFEELGDLNCAVVISPPDQREGHDAIDEESNDKIQRFWQRMMNRYGTAEDYEDAIKDEFIHGDDIDLLIVVDKLLTGFDAPRASILYIDKPMKEHTLLQAIARVNRLYEGKDYGLIIDYRGLLSKLDEALQMYSGAGLENFDPKDLQGAIHDVISVVGSLRQHHSDLLQLFSSIKNKQDVEEYEVLLEDEEKRESFYDTLSQFGRNLGIALESERIYNALQPEELATYKKDLKFFQELRKSVKLRYSDTIDHKEYEAKMQKLMDQYISAEQVIRITNPVDILNEKAFEEELERLESKRAKADAIRTRLTKSVHAKWDENPAYYKKFSERIQEAIQEYKDKRISEAEYLNKMKDIMNDYRNGESKEDYPTVIKENKDAQAFYGVTKDILSETKEERASYGEDLLGELALKMDEIIKQHQKVDWHNNLQIHNRIAQDLDDLLYDFSKEHNVELDYDTIDKLIEQIKTVAIRRY

SEQ ID NO: 8337 - protein, 387 aa, Bacillus licheniformis
MEAFKQYKWENGNLSDIADITMGQSPPGNSYNDIKDGIGLINGPTEFTNKYPVVKQWTSKPTKLCKAGDILLCVRGSSTGRMNIADDEYCIGRGVASIRAKKDKAETSFIYYTLNYKVNQLLQKTAGSTFPNLSSNEIKDMIVGIPLFAEQQKIASILSTWDKAIELKEKLIEQKKEQKKGLMQKLLTGKVRLPGFSDKWEKKKIGELLEESKVIAKNPQLDKRITVRLNLKGVCKREISTVEKEGATTQYIRKEGQFIYGKQNLHKGAFGLIPKELDGFQSSSDIPCFDFKEGVDGLWFYYYFSRESFYTNLENISSGTGSKRIQPKELYKLTIKLPSLREQQRQSKILECSDKEIYLLEKELETYRKQKQGLMQLLLTGKVRVKV

SEQ ID NO: 8338 - protein, 334 aa, Bacillus licheniformis
MNNESNFLMYQTENGDTKIQVRLEGETVWMTQKAMAELFQKGVPTINEHIKNIYAEGELTEEATIRKNRIVQVEGSREVEREVTFYNLEVIIAVGYRVRSHRGTQFRQWATERLNEYMVKGFTMDDERLKEMRNIGADYFDELLERIRDIRASERRFYYKITDIYATSIDYDPNTPIAREFFATVQNKLHFAIHGHTASELIMKRADATKPNMGLTSWKGDKVRKHDVTVAKNYLTQEELSDLNRIVTMYLDYAETQAKKKKPMYMKDWAEKLDAFLEFNEHEILTNAGKIKAKVAEQFANEQYEVFHQQRLAEPKKDDFDQFLEQRKQLDSEK

SEQ ID NO: 8339 - protein, 164 aa, Bacillus licheniformis
MLAKGDFYYGAFLSQLVNSGFAPAIFENSEKRRIYKLSTNYGDYKVYTKYVSKQSNKGQNRMWHFPFNLDEVNNIQQDQSINMFAFICGVEDLVNSEIVILSREEFNQCIGVGFKTENRRVSVKSEKGAWNHLVYGTGIELKETPLKVIKNLNKRLSEFSMVST

SEQ ID NO: 8340 - protein, 509 aa, Bacillus licheniformis
MSEKVTKDQINSVLWQAADTFRGKVDSSTYKDYILTMLFIKYLSDAYKEHLEEYTKRYNGDEQRIQRALSRERFVLDEQSTFDYLYSKRNDAEIGEIINKALERLENENTGKLRGVFRNIDFNSEAILGKAKERNAMLRSLLEDFNKLTLKPSVVGSEDVIGDAYQYMIERFASDAGKKGGEFYTPSMASELLARLVKPQENDRVYDPTCGSGSLLIRVANQVPNKKVAIYGQERNGATHSLALMNMYLHGIDDAKIEWGDTLANPLHLEDGKLMKFQAIVANPPFSLDKWAMGFAGEGTNDSKFKMEASLDPHRRFEWGVPPSSKGDYAFVQHMLYSLAENGRMATILPHGVLFRGASEGKIRQQIIEMNLLDAVIGLPEGLFYGTGIPACILVFKKNRTRKDVLFIDASAEGNYEKGKNQNQLREQDIAKIVDTYEKRETIDKYSYVATLDEIKENDYNLNIPRYVDTFEEEEPVDMHAVKENIANIKQELQEVEAEMEKYLKELGL

SEQ ID NO: 8341 - protein, 198 aa, Bacillus licheniformis
MNLGDIADIRTGLVLTRKKVEVGNEVKATYNLITLKNITEEGVFNDEPFEVFHSNDLLNNQHFTEAGDVLIRLNYPHTSVYIDETKSGLLVPSYFAIIKVDQSKFISEYVAWYLNTDSVKKELERSQAGTRIPSTNKSALNSIPIEDIPIFKQQAVIKLWRLHQQEKTLYNRLIEEKEKWFNAITKQIVQGEIREELE

SEQ ID NO: 8342 - protein, 187 aa, Bacillus licheniformis
MFEVLQKRLPYFLNFHYRKKTNLHDHVLTVGSGRSNISYRCSANNAKSLAFVELNFDSSRGKEYERFKNMEQTIRQKIHSQVIFKDRKVGVYFQPLQTYEETFEQIAEIFEQFILFFSPYLYGGKDINVISEQEEKGTKGIQSAILTRLDYSPNRLVEDFLEEEPWEIEDSHRIRQEGMADFYLYNG

SEQ ID NO: 8343 - protein, 57 aa, Bacillus licheniformis
MKESPTLNLHEEIEKQLLIGAELEKYNARKFLNLLSDMIVKYESTIYDKFKESRLGA

SEQ ID NO: 8344 - protein, 71 aa, Bacillus licheniformis
MRAVGYVRVSTDKQLDNTSIGKQREEIEKYCKNNDISLVHIFDEGAKSAESFKNRTEFKELYSFVLDKKTK

SEQ ID NO: 8345 - protein, 414 aa, Bacillus licheniformis
MHEIKRVAIYCRVSTEEQATEGYSISAQLQTLRQYTQLYGWEIAEEYVDEGISGKNISGRPAMQKLISDVEKDKFQAVLVWKISRLSRNMLDTLTLLDKFEDYGVKFISYSENFDTGSPIGRLVVQLMASIAEMERNTLSENVKLGMKQRALEGSWNGGVVFGYDTIEKELVINKKEAEIVQQIYQLYANGKGLKSIANYLNKAGYRTKRNCYFSINGVAQILDNVIYNGKISWLKVENWDTKRRRGKNPNPILVEGQHEAIISDELWSMVQARRKSKSFKQRQSNEPFLLSSLLRCPDCGQGMVPAITTNKRKDGTKKKYRYYVCSNFHNKGSSACRANSIKAYDAEYEVINKIEKILSNQNQLFSKLQSINTTSIESLNQLNSELKQLENRLSEIQEYRIVTWKHLSKRPYQ

SEQ ID NO: 8346 - protein, 159 aa, Bacillus licheniformis
MNISIVAIGKLKEKYLKQGIDEYIKRLSAYAKVDIIELPDEKAPENLSDQDMKIVKDKEGERILSKISPDAHVIALAIEGKMKSSEELADNMDRLATYGKSKATFVIGGSLGLSDAVLKRADEKLSFSRMTFPHQLMRLILLEQVYRAFRINRGEPYHK

SEQ ID NO: 8347 - protein, 52 aa, Bacillus licheniformis
MKSCEEHIETVIDMYVDEEELAPEIRKIEHTHSLSTTCELCDKPAVYIVGNE

SEQ ID NO: 8348 - protein, 160 aa, Bacillus licheniformis
MSKELEEFPKIKPLYAVLLTIITSGIYIPYWFLSRRKNLERCQIKLPYVAIKVTLLLSVFSILEPFWTFYSITFQSEDLLPYSNSILLLPLRPGHSFLPQLSFLLFWTVNLYSAFKVRKAFIGLSEKQVNGFWTFILNVSYLQYITNQHSLVVQEKREAV

SEQ ID NO: 8349 - protein, 173 aa, Bacillus licheniformis
MMLKSKIKIDLNKPRKKPEIRLTPMTEEDFKIYQTYSIQHYAMEKVKAGTWTVAEAMEKAEEQFAALLPNGIETINHYLWSIMNDSGNAAGWVWIYADPHHPQKEAFIYDFGLYEAYRGQGIGQQALAVLEEEAKQLGVKKLSLHVFAHNKKAKRLYEKMNFETTDLHMSKRL

SEQ ID NO: 8350 - protein, 156 aa, Bacillus licheniformis
MNDNVQAALKTLSNVKSRSILSVFVLCLITLGVYIPYWFLSRKKSFDLLPYHDIPYTTLKAIIFYHLFSIPIRISAKIAFPDMHYSLYMLLDRVILILSAGVLIYCALVVTASLNKLSGKEPANGSIFAFLLNIIYIQHRINKLSEPKSEWLSKAS

SEQ ID NO: 8351 - protein, 281 aa, Bacillus licheniformis
MSQHALVLQSDFGLDDGAVNAMYGVAYSVDSSIRIFDLTHNIPVFHICEASYRLLQSVSYWPEGTVFVSVVDPGVGSERRSVAVRTSSNQYIITPDNGTLTHISRQNGIAEARYLDEAQNRLPKSGESHTFHGRDIYAYTGARLAAGALSFDRIGPEVSIDSIVKLPVMEAYIENDWITGTIDILDVRFGNLWTNISRTLFKSLDVQYGDPVEVVIKHEDTKVYQQTLAFGRSFADMPVGKPVVYINSLDRLGIALNQGSFAKTYHIGTGINWRISLRKSI

SEQ ID NO: 8352 - protein, 403 aa, Bacillus licheniformis
MEFNHDEEKFVREKPVRSWRSFLFSSLVGAVIGALLTVFALPYLSQQGWLPYNLQVIEARGGQGAQQGGTVRNVSVNVNNEVTQMVSKVSDSVVGVINIQKTGVWDGDSEAGTGSGVIYKKDGNTSHIVTNHHVIEGASQIEISLNDGTRIPAKLIGSDKLMDLAVLQVNSNKIKAAAEFGDSDKVKTGEPVIAIGNPLGLQFSGSVTQGIISGTERAVPVDSNGDGQPDWNAEVLQTDAAINPGNSGGGLFNIDGKVIGINSMKIAESAVEGIGLSIPANLAIPVIEDLETYGEVRRPYLGIEMKSLGDIASYHWQETLKLPKNVTSGVVVMGVQPVSPAGRAGLKELDVIVEFNGDRVYDIVDLRKKLYTKNVGDKVKIKYLRGGKEKTTEVKLTRSQLGS

SEQ ID NO: 8353 - protein, 264 aa, Bacillus licheniformis
MSLQFSVLASGSTGNALYLETDDHAFLVDAGLSGKAMEGLMAQIDRKLDQLDGIFVTHEHSDHIKGLGVLARKYELPVYANEKTWKAMEGHIGKMDNGQKFVFPMETVKSFGSLDVESFGVSHDAAEPMFYVFHYNGRKLALITDTGYVSDRMKGIIRSANAFVFESNHDVGMLQMGRYPWNIKRRILSDVGHVSNEDAALAMTDVIGNETSRIYLAHLSQDNNMKELARMSVQQTLAAKGFAAGETFDLYDTDPKKPTPLVAV

SEQ ID NO: 8354 - protein, 282 aa, Bacillus licheniformis
MEWNRTKTIFIIVFLILDIFLAFQYFNKRSNNQFPILEKSTLQEDMKADHISYGNLSKETSKGSSISAQKRVFKQSEIKSLKGQKPKALMNTAKENALTEIEMEFETPIALPKTDMKTKAREIVNEEIIDGNKYKLWKVDKSGKQIVFFQTYNGNYIFQDRQNDDNNEMGEVVLYLNNKNEVVSYKQSMLQDIKEVKTENLISAVGAVEALYYPDYLKKYSKIKSAELGYFTQYPLASAQIFVPVWRIEVERKTDDKTIHEEFIVDARDGALLQSQEKKEKS

SEQ ID NO: 8355 - protein, 454 aa, Bacillus licheniformis
MKRETIKTIILSLLVLISLLFTFNIWGFQGNYEKVEDSQAQVSDKQPITNQTKLLNEAVKPQQMFIHENGQHYLLNDTTLYSQLWDDMGRWEVKSLKDISDKFDRQQFKNWLYAKNKDSKLDLVFSDNIPIDVLQPLFKWSANSYEYNSFDRIVLPFNEGRGMKKIYFVSFSKETVVEAVIESANYRNILSDIEKEKSQMPLYEDFAINSRRDVLLPVNRLKLSEKEYFTETISPTRFKKALFDDPQTVRQETNLNRPVYTDGTSLLEIYSNNRQIKFQHRNLEPSTSYQNGELINKSFKYLNDTGSWTDDYQFFGLNENQQINFNLFMDQLPVVNSQNQPFGTTSIELRWANNDILDYKHPTYVLGANANPVSKKDKEIMSGEELIQFLQDNEEYDFDKIEQIFPAYEMVSVSEEQDPLVKLVPTWCIKINGTVKPVSKKDSAVKEGIENGVE

SEQ ID NO: 8356 - protein, 614 aa, Bacillus licheniformis
MNKVSFFRSIHFKFTLIYVLLIIVAMQIIGVYFVNEMEKSLLKSYNDSLDQRVNNLSYYLEQEMTKDRSTSSSSTLKEDAERILNDFSKEGEILEVSLIDKSYEVIATSNPYNREVAGKKTTEGIIKRTLLVGIPYENKFFDPERDSKVRISVTPIKKSNQETIGAIYVVASMDNVYNQIRTINTILASGTFIALGITAFLGIFVARTITHPLSDMRKQAIELAKGNFSRKVRKYGNDEIGQLATTFNYLTRELKEAQSMTEGERKKLSSVIAYMTDGVIATNRNGAIILLNTPALELLNVSRETALEMPITSLLGLEDEYTFEDLVEQQDSLLLEIEQEERTSVLRVNFSVIQKEHGKIDGLIAVIYDVTEQEQIDQERREFVANVSHELRTPLTTMRSYLEALAEGAWQDPNIAPRFLNVTQNETERMIRLVNDLLQLSKFDSKDYQFNKEWIHFIRFFSLIIERFEMTKEQHVEFISNLPDRELYVEIDPDKITQVLDNIISNALKYSPEGGHITFSVDVNEEEELLYVSVKDEGVGIPRKDVEKIFERFYRVDKARTRRLGGTGLGLAIAKEMVQAHSGDIWADSIEGKGTTITFTLPYKEEQEDDWDEA

SEQ ID NO: 8357 - protein, 235 aa, Bacillus licheniformis
MEKKILVVDDEKPIADILEFNLKKEGYEVHCAYDGNEALQMVEDLNPDMILLDIMLPNKDGVEVCREVRKKYDMPIIMLTAKDSEIDKVIGLELGADDYVTKPFSTRELLARVKANLRRQNTAAPAEEESSSNEIQIGSLVIFPDAYVVSKRDETIELTHREFELLHYLAKHIGQVMTREHLLQTVWGYDYFGDVRTVDVTVRRLREKIEDNPSHPSWIVTRRGVGYYLRNPEQD

SEQ ID NO: 8358 - protein, 136 aa, Bacillus licheniformis
MERVDVVYSFAEENNILMVKNKKNQSWTLPGGKVEAGESLTEAAAREMKEETGYGIQPLDILAVNEAVISSEHVYFIVFRARITDRPDAITFDENIVEAKWVPLHEADRLLSVFHPNGIMHWLNREGAEYHHEGKK

SEQ ID NO: 8359 - protein, 430 aa, Bacillus licheniformis
MSSVVVVGTQWGDEGKGKITDFLSENAEVIARYQGGNNAGHTIKFNGVTYKLHLIPSGIFYKDKTCVIGNGMVVDPKALVTELAYLHERNVSTDNLRISNRAHVILPYHLKLDAVEEERKGANKIGTTKKGIGPAYMDKAARVGIRIADLLDRDVFEEKLARNLEEKNRLLEKMYDAEGFKIEDILDEYYEYGQQIKQYVCDTSVVLNDALDDGRRVLFEGAQGVMLDIDQGTYPFVTSSNPVAGGVTIGSGVGPTKIQHVVGVSKAYTTRVGDGPFPTELNNEIGDQIREVGREYGTTTGRPRRVGWFDSVVVRHARRVSGITDLSLNSIDVLTGIETLKICVAYKYRGEILEEFPASLKALAECEPVYEEMPGWTEDITGAKSLSDLPENARHYLERVSQLTGIPLSIFSVGPDRSQTNVVRSVYRPN

SEQ ID NO: 8360 - protein, 88 aa, Bacillus licheniformis
METVLIFASVLSPIILALVELVKKTVKMPKNLIPLVSLLIGLLIGAAAYPFTDLELVLRLWSGGLAGLTATGLFEIGKNRNARKKKNP

SEQ ID NO: 8361 - protein, 454 aa, Bacillus licheniformis
MTDLLNDRLPPQNIEAEQAVLGAVFLEPSALTLASEVLIPDDFYRMSHQKIFNAMLVLGDRGEPVDLVTVTSELANTDLLEEVGGISYLTDIANSVPTAANIEYYAKIVEEKSILRRLIRTATTIAQDGYTREDEVEDLLSEAEKTIMEVAQRKNSGAFQNIKDVLVQTYDNIEQLHNRKGDITGIPTGFTELDRMTAGFQRNDLIIVAARPSVGKTAFALNIAQNVATKTDESVAIFSLEMGAEQLVMRMLCAEGNINAQNLRTGNLTEEDWGKLTMAMGSLSNSGIFIDDTPGIRVSEIRSKCRRLKQENGLGMILIDYLQLIQGSGRSSDNRQQEVSEISRALKALARELEVPVIALSQLSRGVEQRQDKRPMMSDIRESGSIEQDADIVAFLYRDDYYDKESENKNIIEIIIAKQRNGPVGTVSLAFVKEYNKFVNLERRFDDAGVAPGA

SEQ ID NO: 8362 - protein, 65 aa, Bacillus licheniformis
MKVYTVSPNAETDGWFLKLEDTAPVELYDTRTEAVEKGEEMAKENRPAKLVIYDRQDNKEDERSY

SEQ ID NO: 8363 - protein, 92 aa, Bacillus licheniformis
MTSELEEKEKSDINKAEVIVLKSTISELKKKLYEQQIRAKGLYTFEEYKDMRNVLQTLRMKFAAYEEWDLYQHATDLMVSIPLKNSWNSRVD

SEQ ID NO: 8364 - protein, 401 aa, Bacillus licheniformis
MHYIDARRARLNNIFLIAGIIFIAFNLRPAITAVGPLISSIRSDMDLTNGMAGFLTTLPLLSFAVLSPVAPKLGQKLGNERTLWVGLVILLIGILLRSYGESITLFAGTALIGVGIAICNVLLPSLIKHKFPDKAGIMTSFYTTAMSIFAALASGISIPLSHGLAWGWSASLMVWAGLAFVAILIWVPQLRYHDTGNRTVSLKADGQTVWRSKIAWQVTFFMGIQSFLFYCTIAWLPEILRSHGMSMSLAGWMLSLMQFASLPSTFLTPVLAGRFQNQKSIVLALGILYLAGMSGLLYGGSTAMLTLWVILIGIGQGSSISLALTLIGLRSENADQAAALSGMSQSAGYLLAAIGPSFVGFLYDHMHSWNGPILLFIGALVALIGAGLGAGRNQYIYAKAA

SEQ ID NO: 8365 - protein, 401 aa, Bacillus licheniformis
MKTKPSQRYIFKHLHIYSENGMIEDGFLLTNGEKIEAYGPMADIPASAQTAEQLTFPENFKVLPGMIDVHIHGANGADVMDGTAEALQTMAEALPKEGTTSFLATTMTQDKATIEHALANVHRYKEAGGRPGTAEVLGVHLEGPFISEKRCGAQPPDDIIAPDLSLFKEWQRISGNNIKLVTLAPELEGSLELISFLKETGVIASAGHSDAGLKEMEAGIKAGLSHVTHLFNGMRGLHHREPGTAGSALLHDELKAEVIADGIHVHPAVIKLAFQQKQKEGIILITDAMRAKCLKNGTYTLGGQEVFVKGDKAVLRDGTLAGSILKMNQAALNMMDFTGCSLEDIVYMTAVNPARQLHIYDRKGSIRSGKDADLIILNEKNEVVMTLCKGVIAFSKREVSP

SEQ ID NO: 8366 - protein, 248 aa, Bacillus licheniformis
MKIIEAKDYQDMSQSAARFIIEQVNRLSAPVLGLATGGTPLGTYQVLREDHARNKTTYKHVYTVNLDEYVGVSPDHENSYTFYMKKQLFDHIDIPLSHTHLPNGMACDQDAECSRYEALIERLGGIDLQVLGLGLNGHIGFNEPGTPFSSKTHTVELTQSTKEANARYFDSYDAVPSQAITMGISTIMKSKQILLLVSGEKKAGILAKLLTEEPNEDTPASVLKTHQDVVIIADSDALSIVKERGMAF

SEQ ID NO: 8367 - protein, 243 aa, Bacillus licheniformis
MIKKDSHIPIYYQIETEIKKLAETKDLKPGDLIPSEREFAEKYEVSRMTVRQAVNNLVNEGILVRQRGKGTFIAEPKIEQPLKGLTSFSEDMKSRGMRPGTKMLGFGVIPCDQSTARKLEIREGASVYEVKRIRLADDIPMAYEISYLPADFINGLTEDIMSASLYDYVENTLSLTIDRAAQTLEPAIASQAESEPLDIEEGAPVLLIERLSYLDDGRPFEVVKSVYRGDRYKFVIDMKRKDQ

SEQ ID NO: 8368 - protein, 298 aa, Bacillus licheniformis
MRKTENTNDKSTALDEMNALDIVTLMNEEDHTVPRAITPCLPLIAEAAETIVSRFEQGGRVFTAGAGTSGRIAVLDAAELPPTFSIDESRWTGLIAGGYDAMWMPLEENEDDREKIVADLKAQSFSKDDVLIGVTASGSTPYVLGALSYAKQIGAASVSISCNADTEAGKLSDIAIEVQTGPEIIRGSTRLKAGTAQKMILNMLSTAAMVRLGRVYQNEMVNMRLLNQKLAGRAVTILMNTTGLSEDEALQALKESGNDIKAAIFMTLTNGTLEVARRCLSHENGHLKKAIQYHRKGF

SEQ ID NO: 8369 - protein, 457 aa, Bacillus licheniformis
MLGFLQNIGRALMLPIAVLPAAGLLLALGREDLLNIPFIAASGQSILDQLPIIFAIGVAIGLSKDGHGAAALSGAIGYFVLTGGLAAINKDLNMGVLGGIIAGVVAAVMYNRFKDAKLPDWLGFFGGKRSVPIMTAFCSIILAGIFGFVWIYAQQAIDAIGGWIIHAGALGVGIFGLLNRLLLPLGLHHILNNMVWMVFGEFAGKTGDMNRFFAGDPSAGAFMTGFFPIMMFGLPAACLAMIAAAKKHRRKATAGLLIGLAFTSFLTGITEPIEFTFMFLSPLLFGIHALLTASAMTVTNMLGIHHGFTFSAGTIDYLLNFGIATKPLLLLPLGLVYGIIYFIIFYFLITKLNLKTPGREDDDEQENTAVSPDTGSSKYETLADKYIEALGGKENIETLNNCVTRLRLKVRDASKLDESAMKSMGAKGFVKLNQHEVQVIIGTDVEFLANEMRKRTE

SEQ ID NO: 8370 - protein, 149 aa, Bacillus licheniformis
MKVIFLQDVKGKGKKGEVKNVADGYAHNFLIKKGLAVEATSANISALEGQKKKEKKEAAEELKSAKELKKQLEEITVELSAKSGEGGRLFGSVTSKQIADALQKGHQLKVDKRKIELNDAIRSLGYTNVPVKLHPEVQATLKVHVKEQS

SEQ ID NO: 8371 - protein, 660 aa, Bacillus licheniformis
MPSFYEKPLFRYPIYSLIVVTIISVLINIYFNWVAGAAGVLILGVILYFLKRADSQIRKELDDYISTLSYRLKKVGEEALLEMPIGIMLFNDQYYIEWANPFMASCFNENTLVGRSLYDTCESVVPLIKQEVDTETITLNERKFNVVIKREEKLLYFFDVTEQTQIEKQYENERTVLAYIFLDNYDDVTQGLDDQTRSSINSEVTSLLNQWAQEYGIFLKRVSSERFIGVLNEHILSELEASKFSILDEVREKTSVHTISLTLSIGIGASVASLKELGDLAQSSLDLALGRGGDQVAIKQPNGKVKFYGGKTNPMEKRTRVRARVISHALKEIVSESSNVIIMGHKFPDMDSIGSAIGILKVAQANGKDGFVVIDSNQIGSSVQRLIGEIKKYEELWSRFITPEEALEIAKDDTLLVIVDTHKPSFVIEERLVNKIENIVVIDHHRRGEEFIKDPLLVYMEPYASSTAELVTELLEYQPKRLKINMIEATALLAGIIVDTKSFSLRTGSRTFDAASYLRAKGADTVLVQKFLKETADHYIKRAKLIQHTVFYQNGIAIASLPDDEADEYFDQVIIAQAADSLLSMSDVEASFAVARRDENTVCISARSLGEVNVQIIMEALEGGGHLTNAATQLTDITVEETLRRLKEAIDEYFEGGIQK

SEQ ID NO: 8372 - protein, 309 aa, Bacillus licheniformis
MKQTRALVEGAIMVSIFAVLLMISLYIPFIGTILLLTLPLPAMVQTIRHGLKPGISVGLVSLPVSLIAGSLGGLMFAIPVSAAGVIMGFYYRRKEPAQAIAAAAVTYMVSFVLLLIISVQFLGLNLIETANQAYNETFKTFESSIKQFGNDKEVAKQIELLNEQFKQAQYLYPTAIVIFSGITAFLNHLLAKPVLRRIIQIPSLKPFRDMRLPQSIIWIYLLTILLSLAPVEEGSVYYSVLLNASLIMGFVLVIQGFSFVFYFCHAKKLPTVLPVLFLIIGLFSPLLYLVRILGIIDIGFNLRERVKKS

SEQ ID NO: 8373 - protein, 158 aa, Bacillus licheniformis
MTTKTLAWHETLELHELIAAQSVGLVKIKKSMKKISDPQLRQLYSVSAKALEQNLRELLPFLPKAPAFQREDERADLYFDAGDLLVLAKTTVRNYAIAITETATPELRRVLVKQINAAIKLHEQVFYFMYQRGLYPAYNLVDLLKGDAMHAQKAISMR

SEQ ID NO: 8374 - protein, 139 aa, Bacillus licheniformis
MYRHILLAADGSKHSERAADHAIHLASMSNEAVVDMIYVLDYARAKHEVLHSENRTELERERRSRLLSIENKLKQAAVPYQMTMQHGDPGPAIVSYANHHDVDIVIIGSRGLNTLQEMVLGSVSHKVAKRVKCPVLIVK

SEQ ID NO: 8375 - protein, 488 aa, Bacillus licheniformis
MNVKQLNSEWFSNVRGDILSGIVVALALIPEAIAFSIIAGVDPMVGLYASFCIAVVISFTGGRPAMISAATGAMALLMGTLVRDHGLDYLFAATILTGIIQLIFGVLKIARFMKFIPRSVMVGFVNALAILIFMAQVPHFVGVSNMTYVVAGITLLIIYVLPRFTKAVPSALVAIIAMTVFAIFGHFDLRTVGDLGEMKQSLPAFMIPNIPFNFETLAIIFPTAFALSIVGLLESLLTSSIVDDMTDTESDKNRESRGQGIANIVAGFFGGMAGCAMIGQSVINVKSGGRGRLSTFVAGVFLMFLIMVLGDWVVQIPMAALAGVMIMVSIGTFDWSSFSMLRKVPLTDSIVMIVTVVTVVATHDLSKGVFAGVILSAIFFVAKISKLKIEEKSEENAVKYIIKGQVFFASVQDFVNSFKTGEQTKKVILDFSEAHIWDDSAVAAIDKVVLKMKEQGIDVDLIGLNESSWKLVEKLATYDQPHRSVSNH

SEQ ID NO: 8376 - protein, 433 aa, Bacillus licheniformis
MAQELEKRPGHTRWYISSLLSSMIILNYFDRVAISVAAPAIQDSFQLTATQLGIVFSIYTYSYTLMQIPVGSLLDKYGVAWVTRVGMTLWSFLTIILAFLQGKLLLYIVRFLIGLTSASAFPAASKATALWFPPNERGLANSLFDSAAKFANVIGAPLVAFLVTTFDWRAAFLTIGIINVLFTVFFWLYYEQPDRHKRISKEELHYIQKHNAVSEEDISERTLIALKAMLTNRKVWGLMIGFTGYGYTFNLLLTWLPTFFKETYGMDIMSSGLFTAVPWLISTVSGIVVGGWLVDFLIQKGHSNTKVYQTIIVIGMSLGFAFLGAVFTHNITIAIICISVGLAGISATAPIGWSISADIAPVGSISLLSSMVNLANNLFGGIIAVSLTGYLVDVTGSFTLSFLVAGFVLLLGLVFYLAVLGDIKRIRIGKQKT

SEQ ID NO: 8377 - protein, 79 aa, Bacillus licheniformis
MAGGRRGGRAKRRKVCYFTSNGITHIDYKDVDLLRKFISERGKILPRRVTGTSAKYQRKLTVAIKRARQMALLPYVAGE

SEQ ID NO: 8378 - protein, 170 aa, Bacillus licheniformis
MLNRVVLVGRLTKDPELRYTPSGAAVATFTLAVNRTFTNQQGEREADFINCVVWRRQAENVANFLKKGSLAGVDGRLQTRSYENQQGQRVYVTEVQAESVQFLEPKGGGSGSGGYSGGQGGQHFGGGQNEPAPFGGSQNNQNRNQGNSFNDDPFANDGKPIDISDDDLPF

SEQ ID NO: 8379 - protein, 95 aa, Bacillus licheniformis
MRKYEIMYIIRPDVDEESKKAVVERFNNILTTNGAEITETKDWGKRRLAYEINDFRDGFYQILNVQAGAEAVQEFDRLAKISDDIIRHIVVKEEE

SEQ ID NO: 8380 - protein, 366 aa, Bacillus licheniformis
MALTAGIVGLPNVGKSTLFNAITQAGAESANYPFCTIDPNVGIVEVPDERLQKLTELVNPKKTVPTAFEFTDIAGIVKGASKGEGLGNKFLSHIRQVDAICHVVRCFADDNITHVSGKVDPISDIETINLELILADLETVEKRIGRVGKMAKQKDKEAVFEFEILTKLKEAFEQEKPARSVEFSEEQQKVLKQLHLLTTKPVLYVANVSEDEVADPSGNEYVQKVREFAAAENAEVIVVCAKIESEIAELEGEEKAMFLEELGIEESGLDQLIKASYSLLGLATYFTAGEQEVRAWTFKKGMKAPECAGIIHTDFERGFIRAETVAYDDLLEAGSMTAAKEAGKVRLEGKEYIVKDGDVIHFRFNV

SEQ ID NO: 8381 - protein, 68 aa, Bacillus licheniformis
MADKEFGLNDVVEMKKPHPCGTNRWKIIRMGMDIRIKCEGCSHSVMIPRKEFQRKLKKILVKHEESES

SEQ ID NO: 8382 - protein, 337 aa, Bacillus licheniformis
MWRAGMKWMLLILGSLIGAGYASGQEIWQFFGDESGLAILLFTIMFSLSTYIVMKISYEQKSEHFLPVLETLIGPMLAKVYDVLIILYLFTTTIVMIAGGGVTLQIFHIPFWTGVILFCLCTGLLFLWGLNGILSVNSYLIPILVAGLLYALISFQTAHHQPWLLNLTHQYNWPAGIAFTSLNILSVVAVLSAVGKEMKGVGEAKIASILSGLVFGAISYMYNETLVELAGELAHYEIPLFAVLEGAPFPIFIFMTAVLCVAIYTTTISSILGLSSRFLSFVNWPRWVIVILLLSIMAPFTSIGFSNLIAFLYPIYGLLNLYLLVNILLYPILSKWK

SEQ ID NO: 8383 - protein, 205 aa, Bacillus licheniformis
MNRKGGIFSQEPMNEYISHTDPLAVKQIEKVLSVYLKEAGDRPIVIVCIGTDRSTGDSLGPLVGMKLSAKQLTRFHVYGTLADPVHAVNLNEKLDHIHQQHQNPFMIAIDACLGRTKSVGSFQIGKGPLKPGAGVQKSLPEVGHVHINGIVNVSGFMEYFVLQNTRLNLVMSMANVLADGLSHLEKTGSQRRHVSPIERMTGRMS

SEQ ID NO: 8384 - protein, 282 aa, Bacillus licheniformis
MPKGLGKGINALFSNVDLSEETVEEIKLQDLRPNPYQPRKTFDDQSLKDLKESILQHGVLQPIIVRKSIKGYDIVAGERRFRAAEKAGLETIPAIVRELSESLMMEIALLENLQREDLSPLEEAKAYESLLKHLDMTQEQLAKRLGKSRPHIANHLRLLTLPEDVQKLIDNGTLSMGHGRTLLGLKNKKKLEPLVQKVVSEQLNVRQLEKLIQQLNADVPRETKKPKQVKDAVIKERESYLRNYFGTPVTIKKQKKKGRIEIEFYSNEDLERILELLAQEDA

SEQ ID NO: 8385 - protein, 262 aa, Bacillus licheniformis
MFNVKVGDIVGKIIAITNQKGGVGKTTTSVNLGACLAYIGKRVLLVDIDPQGNATSGIGVEKADVDQCVYDILVDDADVKDVIKTTSVENLDVIPATIQLAGAEIELVPTISREVRLKRALESVKQNYDFMIIDCPPSLGLLTINALTASDSVVIPVQCEYYALEGLSQLLNSVRLVQKHLNTDLMIDGVLLTMLDARTNLGIQVIEEVKKYFRDKVYKTVIPRNVRLSEAPSHGKPIILYDPRSRGAEVYLELAKEVAANA

SEQ ID NO: 8386 - protein, 147 aa, Bacillus licheniformis
METRFLMEKVNPEGYRGMLELEKAQASSGIDPILKELIKIRASQLNGCAFCLNMHTKDARQNGETEQRIYALNAWREAPFFTEKERAVLALTEAVTRIGEHGLPDEIYNEVRTHFTEAETAELIMAAVTINAWNRIAIATRKMPAAD

SEQ ID NO: 8387 - protein, 285 aa, Bacillus licheniformis
MEYYRQYHSLLFSIAYRMLGSFQDAEDIIQELFADLQEKDIGQIDHIQAYLTKSITNRCINELQSARKKREVYIGEWLPEPQVALSAQIPAEYVEEKEKVSYAFLVVMSRLNPVERAVLMFREVFGYHYKEISSIIGKSEANCRQIHSRLKQKLNEDISVFSQPVEEQQLAQLFIESAKTGNFEEFSKKLIEDAVLYTDGGGKVRSALRPIYGKSRIYAFFTGVVSKGSFSGRFMPVDINDQKGVLIMKNNRPAYAVCFAWNPEGDSVKNVFIVSNPDKLKHIKI

SEQ ID NO: 8388 - protein, 283 aa, Bacillus licheniformis
MKHSFSRLFGLGDKEEEAEIAEHDTNKEEIQEIPVGDIIPNRFQPRTIFSEEKIKELAATIHTHGIIQPIVVRKTEREGQYELIAGERRWRAVQTLDWEKVPAIIKDFSDTETASVALIENLQREELSSIEEAHAYARLLELHDLTQEALAQRLGKGQSTIANKLRLLKLPEEVQEAILKKEISERHARALIPLKQPDLQVKLLHEVIEKSLNVKQTEDRVVKMLEQDKRKPKPKRKAYSRDARIAMNTIRQSLSMVEDSGVKLNTEEEEFEEYIQFTIRIPK

SEQ ID NO: 8389 - protein, 239 aa, Bacillus licheniformis
MNIEQFTAGLEKKGISLSSFQLEQFETYYEWLVEWNEKMNLTSITEKKEVYLKHFYDSIAASFYVDFKKMNTLCDVGAGAGFPSLPIKICFPHLHVTIVDSLNKRIHFLNQLSDALKLENTAFYHDRAETFGRSKDHRESYDVVTARAVARLSVLSELCLPLVKKDGLFVALKAASADEEIETGKKAIKTLGGKIETVHSFQLPIEESERNIIVIKKQSQTPKKFPRKPGTPNKSPIEG

SEQ ID NO: 8390 - protein, 628 aa, Bacillus licheniformis
MGYEAGQYDVVVVGAGHAGVEAALASARQGAKTLVLTINLDMVAFMPCNPSVGGPAKGIVVREIDALGGEMAKNIDKTHIQMRLLNTGKGPAVRALRAQADKFQYQHEMKKTLENEPNLTMLQGMVERLLIEDGECRGVITQTGAEYRSKTVVLTTGTFLRGKIILGDLSYSSGPNNQQPSIKLSEHLEELGFDLVRFKTGTPPRVNSHSIDYSKTEIQPGDEVPRAFSYETVEYITDQLPCWLTYTSPETHEIIDNNLHRSPMYSGMIKGTGPRYCPSIEDKVVRFNDKPRHQIFLEPEGRNTQEVYVQGLSTSLPEDVQRKMLSTIPGLENVQMMRAGYAIEYDAIVPTQLWPTLETKKIPGLFTAGQINGTSGYEEAAGQGIMAGINAGRKALGKEEVILSRSDAYIGVLIDDLVTKGTNEPYRLLTSRAEYRLLLRHDNADLRLTEIGYQIGLISEERYQKFQEKKAAIEAEKKRLHSVIIKPTKENQEYIRSLGGSELKDGIRATDLMKRPEMNYETVTALAPPEQKVAGDVAEQVEIQIKYEGYIEKSLQQVEKLKKMENKKIPDRIDYDAIKGIATEARQKLKEVRPLSVAQASRISGVNPADISILLVYLEQGRIAKVAE

SEQ ID NO: 8391 - protein, 459 aa, Bacillus licheniformis
MDTIAAISTPMGEGAIAIVRMSGPEALAIADKVYKGPRGKRLSSVDSHTINYGHIVDPETEKVVEEVMVSVLKAPKTFTREDIVEINCHGGLVTVNQVLQLVLREGARLAEPGEFTKRAFLNGRIDLSQAEAVMDLIRAKTDRAMNVAMNQMEGRLSSLIKRLRAEILETLAHVEVNIDYPEYDDVEEMTHKMLIEKATKVKKEIEALLTTSEQGKILREGISTVIIGRPNVGKSSLLNSLVHETKAIVTDIPGTTRDVIEEYVNVRGVPLRLVDTAGIRETEDIVERIGVERSRQVLKEADLILLVLNYSESLSDEDIKLFEATKGMDIIVIVNKTDLEQKLDLDRVRELAGNQPVVTTSLLKEEGIDELEEAIQSLFFTGAIESGDLTYVSNTRHISLLHEAKRAITDALEGIENDVPIDMVQIDLTRCWEVLGEIIGDAVHESLIDQLFSQFCLGK

SEQ ID NO: 8392 - protein, 207 aa, Bacillus licheniformis
MKELTATGRTVDEAVQSGLEQLGLHADDVEVDVVDEGKKGLFGIFGHRSAVVNIREKIDPVKEAKQYLENVISNMGIQAQVTAEEESKRVVFQLKGDKTALLIGKRGQTLNALETLTQLVLNRHSDRYIQAVVDAEGYRAKRKETLAQLALKLADQAARQKKDIHLEPMPSSERKVIHDTLAGYSQHIETYSTGEDHNRHLVISYKK

SEQ ID NO: 8393 - protein, 264 aa, Bacillus licheniformis
MKRRILLLFSMIGVIVLLAGCTEINQPITAESEGFWNTYIVYPLSQLITYVANLTNENFGLAIIIVTILIRLLILPLMIKQTKSSKAMQALQPEMQKLREKYSSKDQKTQQKLQQETMALMQKHGVNPLAGCFPILIQMPILIGFYHAIMRTREIAEHSFLWFDLGERDPYFILPILAGVFTFIQQKLMMAGTAQQNPQMAMMLWLMPIMIVVFAISFPAALSLYWVVGNLFMIAQTFFIKGPDLKAERQEAAAGGKKSGGKKK

SEQ ID NO: 8394 - protein, 119 aa, Bacillus licheniformis
MKKRNRLKKNEDFQKVFKKGKSMANRQYVLYVLHQPEAKEFRVGLSVSKKIGNAVVRNRVKRLIRQVIQEERNLLKQENDYIIIARKPAAELSYEETKKSLQHLFRKSFVYRKKPNQPS

SEQ ID NO: 8395 - protein, 44 aa, Bacillus licheniformis
MKRTFQPNNRKRSKVHGFRSRMSSKNGRLVLARRRRKGRKVLSA
